(12) United States Patent
Bernett et al.

(10) Patent No.: US 9,850,320 B2
(45) Date of Patent: Dec. 26, 2017

(54) HETERODIMERIC ANTIBODIES TO CD3 X CD20

(71) Applicant: Xencor, Inc., Monrovia, CA (US)

(72) Inventors: Matthew J. Bernett, Monrovia, CA (US); Gregory Moore, Azusa, CA (US); John Desjarlais, Pasadena, CA (US); Seung Chu, Cypress, CA (US); Rumana Rashid, Temple City, CA (US); Umesh Muchhal, Monrovia, CA (US); Sung-Hyung Lee, San Gabriel, CA (US)

(73) Assignee: Xencor, Inc., Monrovia, CA (US)

( * ) Notice: Subject to any disclaimer, the term of this patent is extended or adjusted under 35 U.S.C. 154(b) by 0 days.

(21) Appl. No.: 15/185,958

(22) Filed: Jun. 17, 2016

(65) Prior Publication Data

US 2017/0081420 A1    Mar. 23, 2017

Related U.S. Application Data

(63) Continuation of application No. 14/952,714, filed on Nov. 25, 2015.

(60) Provisional application No. 62/085,117, filed on Nov. 26, 2014, provisional application No. 62/084,908, filed on Nov. 26, 2014, provisional application No. 62/085,027, filed on Nov. 26, 2014, provisional application No. 62/159,111, filed on May 8, 2015, provisional application No. 62/251,005, filed on Nov. 4, 2015.

(51) Int. Cl.
| | |
|---|---|
| *C07K 16/00* | (2006.01) |
| *C07K 16/46* | (2006.01) |
| *C07K 16/28* | (2006.01) |
| *C07K 16/30* | (2006.01) |
| *A61K 39/00* | (2006.01) |

(52) U.S. Cl.
CPC ........ *C07K 16/468* (2013.01); *C07K 16/2809* (2013.01); *C07K 16/2818* (2013.01); *C07K 16/2896* (2013.01); *C07K 16/30* (2013.01); *C07K 16/3061* (2013.01); *A61K 2039/505* (2013.01); *C07K 2317/24* (2013.01); *C07K 2317/31* (2013.01); *C07K 2317/35* (2013.01); *C07K 2317/515* (2013.01); *C07K 2317/52* (2013.01); *C07K 2317/522* (2013.01); *C07K 2317/526* (2013.01); *C07K 2317/528* (2013.01); *C07K 2317/55* (2013.01); *C07K 2317/56* (2013.01); *C07K 2317/565* (2013.01); *C07K 2317/60* (2013.01); *C07K 2317/622* (2013.01); *C07K 2317/64* (2013.01); *C07K 2317/73* (2013.01); *C07K 2317/76* (2013.01); *C07K 2317/92* (2013.01); *C07K 2317/94* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 11/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |

(Continued)

FOREIGN PATENT DOCUMENTS

| | | |
|---|---|---|
| EP | 0425235 B1 | 9/1996 |
| EP | 1752471 | 2/2007 |

(Continued)

OTHER PUBLICATIONS

U.S. Appl. No. 12/631,508, filed Dec. 4, 2009, Chari et al.

(Continued)

*Primary Examiner* — Sean Aeder
(74) *Attorney, Agent, or Firm* — Robin M. Silva; Morgan, Lewis & Bockius, LLP

(57) ABSTRACT

The present invention is directed to novel heterodimeric antibodies.

5 Claims, 192 Drawing Sheets

(56) References Cited

U.S. PATENT DOCUMENTS

| | | |
|---|---|---|
| 5,475,092 A | 12/1995 | Chari et al. |
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kunstmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umna et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,303,749 B1 | 12/2007 | Chari |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 8,063,187 B2 | 11/2011 | Chu et al. |
| 8,114,967 B2 | 2/2012 | Bhatt et al. |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,637,641 B2 | 1/2014 | Dahiyat et al. |
| 8,946,387 B2 | 2/2015 | Koenig et al. |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reff et al. |
| 2003/0017979 A1 | 1/2003 | Mack et al. |
| 2003/0091561 A1 | 5/2003 | Van de Winkel |
| 2003/0157108 A1 | 8/2003 | Presta |
| 2003/0223999 A1 | 12/2003 | Lindhofer |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeister et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |
| 2006/0235208 A1 | 10/2006 | Lazar |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais et al. |
| 2009/0214539 A1 | 8/2009 | Grosmaire et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Senter |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Senter |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |

(56) References Cited

U.S. PATENT DOCUMENTS

| | | |
|---|---|---|
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0149876 A1 | 6/2012 | Von Kreudenstein et al. |
| 2012/0156207 A1 | 6/2012 | Chu et al. |
| 2012/0251531 A1 | 10/2012 | Baehner et al. |
| 2012/0251541 A1 | 10/2012 | Baurin et al. |
| 2013/0089541 A1 | 4/2013 | D'Angelo et al. |
| 2013/0095097 A1 | 4/2013 | Blankenship et al. |
| 2013/0101586 A1 | 4/2013 | Riegler et al. |
| 2013/0115208 A1 | 5/2013 | Ho et al. |
| 2013/0129723 A1 | 5/2013 | Blankenship et al. |
| 2013/0142793 A1 | 6/2013 | Ledbetter et al. |
| 2013/0171095 A1 | 7/2013 | Bernett et al. |
| 2013/0195849 A1 | 8/2013 | Von Kreudenstein et al. |
| 2013/0209355 A1 | 8/2013 | De Weers et al. |
| 2013/0336981 A1 | 12/2013 | de Kruif et al. |
| 2014/0024111 A1 | 1/2014 | Kannan et al. |
| 2014/0072581 A1 | 3/2014 | Dixit et al. |
| 2014/0086916 A1 | 3/2014 | Zha |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2016/0060360 A1 | 3/2016 | Moore et al. |
| 2016/0068588 A1 | 3/2016 | Bernett et al. |
| 2016/0176969 A1 | 6/2016 | Bernett et al. |
| 2016/0215063 A1 | 7/2016 | Bernett et al. |
| 2016/0229924 A1 | 8/2016 | Bernett et al. |

FOREIGN PATENT DOCUMENTS

| | | |
|---|---|---|
| EP | 1829895 | 5/2007 |
| EP | 2006381 | 12/2008 |
| EP | 2009101 A1 | 12/2008 |
| EP | 2194066 | 6/2010 |
| EP | 2202245 A1 | 6/2010 |
| EP | 2522724 | 6/2011 |
| EP | 2155788 | 2/2014 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |
| WO | WO9640210 | 6/1996 |
| WO | WO96027011 | 9/1996 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO200124763 A2 | 4/2001 |
| WO | WO200129246 A1 | 4/2001 |
| WO | WO200162931 A1 | 8/2001 |
| WO | WO200183525 | 11/2001 |
| WO | WO200188138 | 11/2001 |
| WO | WO200190192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005063816 | 7/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006072620 | 7/2006 |
| WO | WO2006110476 A2 | 10/2006 |
| WO | WO2006106905 | 12/2006 |
| WO | WO2007005612 | 1/2007 |
| WO | WO2007018431 A2 | 2/2007 |
| WO | WO2007042261 | 4/2007 |
| WO | WO2007047829 | 4/2007 |
| WO | WO2007059404 A2 | 5/2007 |
| WO | WO2007062037 | 5/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007147901 | 12/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008145142 | 12/2008 |
| WO | WO2008150494 | 12/2008 |
| WO | WO2009000006 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010151792 | 12/2010 |
| WO | WO2010151808 | 12/2010 |
| WO | WO2011005621 | 1/2011 |
| WO | WO2011028952 | 3/2011 |
| WO | WO2011036183 | 3/2011 |
| WO | WO2011066342 | 3/2011 |
| WO | WO2011063348 | 5/2011 |
| WO | WO2011066501 | 6/2011 |
| WO | WO2011131746 | 10/2011 |
| WO | WO2011133886 | 10/2011 |
| WO | WO2011143545 | 11/2011 |
| WO | WO2012016227 | 2/2012 |
| WO | WO2012018687 | 2/2012 |
| WO | WO2012032080 | 3/2012 |
| WO | WO2012058768 | 5/2012 |

(56) References Cited

FOREIGN PATENT DOCUMENTS

| | | |
|---|---|---|
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146628 | 11/2012 |
| WO | WO2012162067 | 11/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013125667 | 8/2013 |
| WO | WO2013180201 | 12/2013 |
| WO | WO2014004586 | 1/2014 |
| WO | WO2014012085 | 1/2014 |
| WO | WO2014079000 | 5/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO 2015/026892 | 2/2015 |
| WO | WO2015063339 | 5/2015 |
| WO | WO 2015/143079 | 9/2015 |
| WO | WO2015149077 | 10/2015 |
| WO | WO2015184207 | 12/2015 |
| WO | WO2016014984 | 1/2016 |
| WO | WO2016086186 | 6/2016 |
| WO | WO2016086189 | 6/2016 |
| WO | WO2016086196 | 6/2016 |
| WO | WO2016105450 | 6/2016 |
| WO | WO2016141387 | 9/2016 |
| WO | WO2016182751 | 11/2016 |

OTHER PUBLICATIONS (No Author Name) "A method for making multispecific antibodies having heteromultimeric and common components", Expert Opinion on Therapeutic Patents, Genentech, Inc. (1999) 9(6): 785-790, pp. 785-790.

"Polythene Glycol and Derivatives for Advanced PEGylation", Catalog 2005-2006, Nektar Therapeutics.

"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.

Abbott Laboratories, Strategies and Current Approaches for Improving Drug-Like-Properties During Biologics Drug Candidate Selection, AAPS Webinar—Nov. 10, 2011.

Adams, et al., Avidity-Mediated Enhancement of In vivo Tumor Targeting by Single-Chain Fv Dimers, Clin Cancer Res, 2006, vol. 12(5), pp. 1599-1605, doi:10.1158/1078-0432.CCR-05-2217.

Alberola-Ila et al., Stimulation Through the TCR/CD3 Complex Up-Regulates the CD2 Srface Expression on Human T Lymphocytes, Feb. 15, 1991.

Alibaud et al., A New Monoclonal Anti-CD3? Antibody Reactive on Paraffin Sections, Journal of Histochemistry & Cytochemistry, 2000, vol. 48, p. 1609.

An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., Preparation, properties, and applications of carbohydrate conjugates of proteins and lipids, 1981, CRC Crit. Rev. Biochem., pp. 259-306.

Arnett, et al., Crystal structure of a human CD3-ε/δ dimer in complex with a UCHT1 single-chain antibody fragment, PNAS, 2004, vol. 101, No. 46, pp. 16268-16273.

Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.

Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.

Atwell, et al., Stable Heterodimers from Remodeling the Domain Interface of a Homodimer using a Phage Display Library, J. Mol. Biol., 1997, vol. 270, pp. 26-35.

Baca et al., Antibody humanization using monovalent phage display, 1997, J. Biol. Chem. 272(16):10678-10684.

Baeuerle, et al., Response to Letter, "Correct TandAb protein," Molecular Immunology, 2007, vol. 44, p. 3084.

Baeuerle, et al., Review—Bispecific T-Cell Engaging Antibodies for Cancer Therapy, Cancer Res, 2009, vol. 69: (12), pp. 4941-4944.

Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.

Bargou et al., Tumor Regression in Cancer Patients by Very Low Doses of a T Cell-Engaging Antibody, Science, 2008, vol. 321, pp. 974-977.

Bhatt, Sea Lane—DDD presentation, "Surrobodies™—A Novel Approach to Bispecifics . . . ," Aug. 8, 2012.

Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.

Biochemica, Your apoptosis specialist, 1999, No. 2, pp. 34-37 (Roche Molecular Biochemicals).

Bird et al., Single-chain antigen-binding proteins, 1988, Science 242:423-426.

Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.

Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.

Bortoletto, Nicola et al., "Optimizing anti-CD3 affinity for effective T cell targeting against tumor cells.", Eur J Immunol. Nov. 2002;32(11):3102-7.

Boswell et al., Effects of Charge on Antibody Tissue Distribution and Pharmacokinetics, 2010, Bioconjugate Chem, 21(21):2153-2163.

Brandi, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.

Brinkmann, et al., presentation slideshow—"Roche Penzberg & Roche Glycart, Schlieren: Centers of Excellence for Recombinant Proteins".

Brinkmann, et al., A recombinant immunotoxin containing a disulfide-stabilized Fv fragment, Proc. Natl. Acad. Sci. USA, 1993, vol. 90, pp. 7538-7542.

Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.

Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.

Carter et al., Antibody-drug conjugates for cancer therapy, 2008, Cancer J. 14(3):154-169.

Carter et al., Humanization of an anti-p185HER2 antibody for human cancer therapy, 1992, Proc Natl Acad Sci USA 89:4285-9.

(56) References Cited

OTHER PUBLICATIONS

Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Cemerski, et al., Suppression of mast cell degranulation through a dual-targeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).
Chelius, et al., Structural and functional characterization of the trifunctional antibody catumaxomab, mAbs, 2010, vol. 2, Issue 3, pp. 309-319.
Chothia et al., Canonical structures for the hypervariable regions of immunoglobulins, 1987, J. Mol. Biol. 196:901-917.
Chothia, et al., Structural Determinants in the Sequences of Immunoglobulin Variable Domain, J. Mol. Biol., 1998, vol. 278, pp. 457-479.
Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.
Conrad, et al., TCR and CD3 Antibody Cross-Reactivity in 44 Species, Cytometry Part A, 2007, vol. 71A, pp. 925-933.
Conrath, et al., Antigen Binding and Solubility Effects upon the Veneering of a Camel VHH in Framework-2 to Mimic a VH, J. Mol. Biol. , 2005, vol. 350, pp. 112-125.
Counterman et al., "Volumes of Individual Amino Acid Residues in Gas-Phase Peptide Ions.", J. Am. Chem. Soc., 1999,121 (16), pp. 4031-4039.
Cuesta, et al., Multivalent antibodies: when design surpasses evolution, Trends in Biotechnology, 2010, vol. 28, No. 7, pp. 355-362, doi:10.1016/j.tibtech.2010.03.007.
d'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.
Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.
Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.
Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.
De Groot et al., De-Immunization of Therapeutic Proteins by T-Cell Epitope Modification, 2005, Dev. In Biologicals, 2005, 122:171-194.
De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.
Del Nagro et al., A critical role for complement C3d and the B cell coreceptor (CD19/CD21) complex in the initiation of inflammatory arthritis., J Immunol. Oct. 15, 2005;175(8):5379-89.
Demarest et al., Antibody therapeutics, antibody engineering, and the merits of protein stability, Current Opinin in Drug Discovery & Development, 2008 11(5): 675-587, Sep. 11, 2008.
Deyev, et al., Multivalency: the hallmark of antibodies used for optimization of tumor targeting by design, BioEssays, 2008, vol. 30, pp. 904-918.
DiGiammarino et al., Ligand association rates to the inner-variable-domain of a dual-variable-domain immunoglobulin are significantly impacted by linker design, mAbs3:5, 1-8; Sep.-Oct.; 3(5):487-94, Landes Bioscience, Sep. 1, 2011.
Dixon, et al., Activation of Human T Lymphocytes by Crosslinking of Anti-CD3 Monoclonal Antibodies, Journal of Leukocyte Biology, 1989, vol. 46, pp. 214-220.
Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.
Doronina , Development of potent monoclonal antibody auristatin conjugates for cancer therapy, 2003, Nat Biotechnol 21(7):778-784.
Dreier, et al., Extremely Potent, Rapid and Costimulation-Independent Cytotoxic T-cell Response Against Lymphoma Cells Catalyzed by a Single-Chain Bispecific Antibody, Int. J. Cancer, 2002, vol. 100, pp. 690-697.
Dreier, et al., T Cell Costimulus-Independent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.
Dubowchik et al., Receptor-mediated and enzyme-dependent targeting of cytotoxic anticancer drugs, 1999, Pharm. Therapeutics 83:67-123.
Ducry et al., Antibody-drug conjugates: linking cytotoxic payloads to monoclonal antibodies, 2010, Bioconjugate Chem. 21:5-13.
Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.
Duke, et al., Measurement of apoptosis and other forms of cell death, 2004, Curr protocols immunol. 3.17.1-3.17.16.
DukSin et al., Relationship of the structure and biological activity of the natural homologues of tunicamycin, 1982, J. Biol. Chem. 257:3105.
Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.
Edge et al., Deglycosylation of glycoproteins by trifluoromethanesulfonic acid, 1981, Anal. Biochem. 118:131.
Elliott, et al., Antiparallel Conformation of Knob and Hole Aglycosylated Half-Antibody Homodimers Is Mediated by a $CH2$—$CH3$ Hydrophobic Interaction, Journal of Molecular Biology, 2014, vol. 426, Issue 9, pp. 1947-1957.
Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.
Feldmann et al., Retargeting of T Cells to Prostate Stem Cell Antigen Expressing Tumor Cells: Comparison of Different Antibody Formats, Dec. 28, 2010.
Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.
Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7) , pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$, 1978, Biochem. Biophys. Res. Commun. 80(4):849-57.

(56) References Cited

OTHER PUBLICATIONS

Francois, et al., Construction of a Bispecific Antibody Reacting with the α- and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate."
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI.
GenBank AAA39180.1, immunoglobulin light-chain VJ region [Mus musculus] Protein/NCBI.
Ghendler et al., One of the CD3ε Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Chemistry, vol. 285, No. 25, pp. 19637-10946, Apr. 16, 2010 & Supplementary Tables.
Haagen, et al., The Efficacy of CD3×CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_l$- and $V_H$-Segments in the Preferential Reassociation of Immunoglobulin Subunits, Molecular Immunology, 1986, vol. 23, No. 5, pp. 503-510.
HAwkins et al, Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.

Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H3$) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83,2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, 5th Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of

(56) References Cited

OTHER PUBLICATIONS arthritis, mAbs, 2012, vol. 4, Issue 5, pp. 600-613, http://dx.doi.org/10.4161/mabs.21227 & Supplemental Data.

Kettleborough et al., Humanization of a mouse monoclonal antibody by CDR-grafting: the importance of framework residues on loop conformation, 1991, Protein Eng. 4(7):773-83.

Keyna, et al., Surrogate Light Chain-Dependent Selection of Ig Heavy Chain V Regions, J. Immunol., 1995, vol. 155, pp. 5536-5542.

Kiewe, et al., Phase I Trial of the Trifunctional Anti-HER2 × Anti-CD3 Antibody Ertumaxomab in Metastatic Breast Cancer, Clin Cancer Res., 2006, vol. 12(10), pp. 3085-3091.

Kim et al., "Localization of the site of murine IgG1 molecule that is involved in binding the murine intestinal Fc receptor," Eur. J. Immunol., 24:2429-2434, 1994.

Kipriyanov, et al., Bispecific CD3 × CD19 Diabody for T Cell-Mediated Lysis of Malignant Human B Cells, Int. J. Cancer, 1998, vol. 77, pp. 763-772.

Kipriyanov, et al., Bispecific Tandem Diabody for Tumor Therapy with Improved Antigen Binding and Pharmacokinetics, J. Mol. Biol., 1999, vol. 293, pp. 41-56.

Kipriyanov, et al., Effect of Domain Order on the Activity of Bacterially Produced Bispecific Single-chain Fv Antibodies, J. Mol. Biol., 2003, vol. 330, pp. 99-111.

Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.

Klein et al., Progression of metastatic human prostate cancer to androgen independence in immunodeficient SDIC mice, 1997, Nature Medicine 3: 402-408.

Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.

Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.

Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.

Kostelny, et al., Formation of a Bispecific Antibody by the Use of Leucine Zippers, The Journal of Immunology 1992, vol. 148, pp. 1547-1553.

Krauss et al., Specificity grafting of human antibody frameworks selected from a phage display library: generation of a highly stable humanized anti-CD22 single-chain Fv fragment, 2003, Protein Engineering 16(10):753-759.

Krupka, et al., CD33 target validation and sustained depletion of AML blasts in long-term cultures by the bispecific T-cell—engaging antibody AMG 330, Blood, 2014, vol. 123, No. 3, pp. 356-365, Prepublished online Dec. 3, 2013; doi:10.1182/blood-2013-08-523548 & Data Supplement.

Kung, et al., Monoclonal Antibodies Defining Distinctive Human T Cell Surface Antigens, Science, 1979, vol. 206, pp. 347-349.

Kuppen, peter et al., The development and purification of a bispecific antibody for lymphokine-activated killer cell targeting against the rat colon carcinoma CC531., Cancer Immunol Immunother. Jun. 1993;36(6):403-8.

Labrijn, et al., Efficient generation of stable bispecific IgG1 by controlled Fab-arm exchange, www.pnas.org/cgi/doi/10.1073/pnas.1220145110 & Supporting Information.

Laszlo et al., Cellular determinants for preclinical activity of a novel CD33/CD3 bispecific T-cell engager (BiTE) antibody, AMG 330, against human AML, blood 2014 123: 554-561, Dec. 5, 2013.

Lau et al., Conjugation of Doxorubicin to monoclonal anti-carcinoembryonic antigen antibody via novel thiol-directed cross-linking regents, 1995, Bioorg-Med-Chem. 3(10):1299-1304.

Lau et al., Novel doxorubicin-monoclonal anti-carcinoembryonic antigen antibody immunoconjugate activity in vitro, 1995, Bioorg-Med-Chem. 3(10):1305-12.

Lazar Declaration, Dec. 27, 2010, pp. 1-4.

Lewis, et al., Generation of bispecific IgG antibodies by structure-based design of an orthogonal Fab interface, Nature Biotechnology, 2014, doi:10.1038/nbt.2797 & Supplemental Information.

Li, et al., Construction and characterization of a humanized anti-human CD3 monoclonal antibody 12F6 with effective immunoregulation functions, Immunology, 2005, vol. 116, pp. 487-498.

Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.

Ling, et al., Interspecies Scaling of Therapeutic Monoclonal Antibodies: Initial Look, J Clin Pharmacol, 2009, vol. 49, pp. 1382-1402, doi: 10.1177/0091270009337134.

Link, et al., Production and Characterization of a Bispecific IgG Capable of Inducing T-Cell-Mediated Lysis of Malignant B Cells, Blood, 1993, vol. 81, No, 12, pp. 3343-3349.

Linke, et al., Catumaxomab, Clinical development and future directions, mAbs, 2010, vol. 2, Issue 2, pp. 129-136.

Little, et al., Letter to the Editor, "Flawed TandAb production," Molecular Immunology, 2007, vol. 44, p. 3083.

Liu et al, Asymmetrical Fc Engineering Greatly Enhances Antibody-dependent Cellular Cytotoxicity (ADCC) Effector Function and Stability of the Modified Antibodies, J. Biol. Chem. 2014, 289: 3571-3590, Dec. 5, 2013.

Liu et al., Eradication of large colon tumor xenografts by targeted delivery of maytansinoids, 1996 Proc. Natl. Acad. Sci. USA 93:8618-8623.

Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.

Lode et al., Targeted therapy with a novel enediyene antibiotic calicheamicins $o^I_1$ effectively suppress growth and dissemination of liver metastases in a syngeneic model of murine neuroblastoma, 1998, Cancer Res. 58:2928.

Löffler, et al., A recombinant bispecific single-chain antibody, CD19×CD3, induces rapid, and high lymphoma-directed cytotoxicity by unstimulated T lymphocytes, Blood, 2000, vol. 95, No. 6, pp. 2098-2103.

Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.

Lu, et al., Di-diabody: a novel tetravalent bispecific antibody molecule by design, Journal of Immunological Methods, 2003, vol. 279, pp. 219-232.

Lu, et al., Fab-scFv fusion protein: an efficient approach to production of bispecific antibody fragments, Journal of Immunological Methods, 2002, vol. 267, pp. 213-226.

Lu, et al., The effect of variable domain orientation and arrangement on the antigen-binding activity of a recombinant human bispecific diabody, Biochemical and Biophysical Research Communications, 2004, vol. 318, pp. 507-513.

Lum, et al., The new face of bispecific antibodies: targeting cancer and much more, Experimental Hematology, 2006, vol. 34, pp. 1-6.

Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.

Lutterbuese, et al., T cell-engaging Bite antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.

Ma, et al., Expression and Characterization of a Divalent Chimeric Anti-Human CD3 Single Chain Antibody, Scand.J.Immunol, 1996, vol. 43, pp. 134-139.

Mabry, et al., A dual-targeting PDGFRβ/VEGF—A molecule assembled from stable antibody fragments demonstrates anti-

(56) References Cited

OTHER PUBLICATIONS angiogenic activity in vitro and in vivo, mAbs, 2010, vol. 2, Issue 1, pp. 20-34; www.landesbioscience.com/journals/mabs/article/10498 & Supplemental Information.

Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.

Mack, et al., A small bispecific antibody construct expressed as a functional single-chain molecule with high tumor cell cytotoxicity, Proc. Natl. Acad. Sci. USA, 1995, vol. 92, pp. 7021-7025.

Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.

MacroGenics Factsheet, Dual Affinity Re-Targeting ("DART") Platform, 2010.

Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.

Mandler et al., Modifications in synthesis strategy improve the yield and efficacy of geldanamycin-herceptin immunoconjugates, 2002, Bioconjugate Chem. 13:786-791).

Mandler et al., Synthesis and evaluation of antiproliferative activity of a geldanaymcin-herceptin™ immunoconjugates, 2000, Bioorganic & Med. Chem. Letters 10:1025-1028.

Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.

Mandy, et al., Recombination of Univalent Subunits Derived from Rabbit Antibody, The Journal of Biological Chemistry, 1961, vol. 236, No. 12, pp. 3221-3226.

Marks et al., By-passing immunization: building high affinity human antibodies by chain shuffling, 1992, Biotechnology 10:779-783.

Martin, et al., Generation of the Germline Peripheral B Cell Repertoire: VH81X-λ B Cells Are Unable to Complete All Developmental Programs, J. Immunol., 1998, vol. 160, pp. 3748-3758.

Martinez, et al., Characterization of a novel modification on IgG2 light chain: Evidence for the presence of O-linked mannosylation, J. Chromatogr. A, 2007, vol. 1156 pp. 183-187.

Marvin, Bispecific antibodies for dual-modality cancer therapy: killing two signaling cascades with one stone, Curr Opin Drug Discov Devel, 2006, vol. 9(2), pp. 184-193.

Marvin, et al., Recombinant approaches to IgG-like bispecific antibodies, Acta Pharmacologica Sinica, 2005, vol. 26 (6), pp. 649-658.

Mateo et al, Humanization of a mouse nonoclonal antibody that blocks the epidermal growth factor receptor: recovery of antagonistic activity, 1997, Immunotechnology, 3(1):71-81.

McPhee, Engineering human immunodeficiency virus 1 protease heterodimers as macromolecular inhibitors of viral maturation, Proc. Natl. Acad. Sci. USA, 1996, vol. 93, pp. 11477-11481.

Meijer, et al., Isolation of Human Antibody Repertoires with Preservation of the Natural Heavy and Light Chain Pairing, J. Mol. Biol., 2006, vol. 358, pp. 764-772.

Merchant, et al., An efficient route to human bispecific IgG, Nature Biotechnology, 1998, vol. 16, pp. 677-681.

Mertens, Nico, "Tribodies: Fab-scFv fusion proteins as a platform to create multi-functional pharmaceuticals.", SpringerLink 2011,135-149.

Metz, et al., Bispecific antibody derivatives with restricted binding functionalities that are activated by proteolytic processing, Protein Engineering, Design & Selection, 2012, vol. 25, No. 10, pp. 571-580.

Metz, et al., Bispecific digoxigenin-binding antibodies for targeted payload delivery, PNAS, 2011, vol. 108, No. 20, pp. 8194-8199.

Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.

Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.

Miller et al., Stability engineering of scFvs for the development of bispecific and multivalent antibodies, PEDS, 2010, vol. 23, No. 7, pp. 549-557 & Supplementary Data.

Miller, biogen idec Stability Engineering and Production of IgG-like Bispecifc Antibodies, AAPS National Biotechnology Conference, Jun. 24 to Jun. 27, 2007.

Milutinovic, et al., Sanford Burnham Medical Research Institute / AACR Poster, #4318, "Development of a novel dual agonist Surrobody™ that simultaneously activates both death receptors DR4 and DR5 and induces cancer cell death with high potency".

Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.

Mimoto, et al., Novel asymmetrically engineered antibody Fc variant with superior FcγR binding affinity and specificity compared with afucosylated Fc variant, mAbs, 2013, vol. 5, Issue 2, pp. 229-236.

Modjtahedi et al, Phase I trial and tumour localization of the anti-EGFR monoclonal antibody ICR62 in head and neck or lung cancer, 1996, Br J Cancer, 73(2):228-35.

Modjtahedi et al, Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.

Modjtahedi et al., Antitumor activity of combinations of antibodies directed against different epitopes on the extracellular domain of the human EGF receptor, 1993, J. Cell Biophys. 1993, 22(1-3):129-46.

Modjtahedi et al., The human EGF receptor as a target for cancer therapy: six new rat mAbs against the receptor on the breast carcinoma MDA-MB 468, 1993, Br J Cancer. 1993, 67(2):247-53.

Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

Moore et al., Tuning T Cell Affinity Improves Efficacy and Safety of Anti-CD38×Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.

Moore, et al., A novel bispecific antibody format enables simultaneous bivalent and monovalent co-engagement of distinct target antigens., MAbs. Nov.-Dec. 2011; 3(6): 546-557; Published online Nov. 1, 2011. doi: 10.4161/mabs.3.6.18123.

Moore, et al., Application of dual affinity retargeting molecules to achieve optimal redirected T-cell killing of B-cell lymphoma, Blood, 2011, vol. 117, No. 17, pp. 4542-4551.

Moretti et al., BEAT® the bispecific challenge: a novel and efficient platform for the expression of bispecific IgGs. BMC Proceedings 2013 7(Suppl 6):O9.

Morrison, et al., News and Views: Two heads are better than one, Nature Biotechnology, 2007, vol. 25, No. 11, pp. 1233-1234.

Mosmann, 1983, Rapid colorimetric assay for cellular growth and survival: application to proliferation and cytotoxicity assays, J. Immunol. Methods 65:55-63.

Muda, et al., Therapeutic assessment of SEED: a new engineered antibody platform designed to generate mono and bispecific antibodies, Protein Engineering, Design & Selection, 2011, vol. 24, No. 5, pp. 447-454.

Murthy et al., Binding of an antagonistic monoclonal antibody to an intact and fragmented EGF-receptor polypeptide, 1987, Arch Biochem Biophys. 252(2):549-60.

Nagorsen, et al., Blinatumomab: A historical perspective, Pharmacology & Therapeutics, 2012, vol. 136, pp. 334-342, http://dx.doi.org/10.1016/j.pharmthera.2012.07.013.

Nelson, et al., Point of View: Antibody fragments—Hope and hype, mAbs, 2010, vol. 2, Issue 1, pp. 77-83.

(56) References Cited

OTHER PUBLICATIONS

Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T-δ and T3-ε) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.I X-ray molecular structure of N,N-dimethylvalyl-valyl-dolaisoleuine tert-butyl ester, 1996, J. Chem. Soc. Perkin Trans. 1 5:859-863.
Pettit et al., Specific activities of dolastatin 10 and peptide derivatives against *Cryptococcus neoformans*, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproine1, 1996, Synthesis 719-725.
Pichler et al., Differences of T-Cell Activation by the Anti-CD3 Antibodies Leu4 and BMA030, Mar. 30, 1987.
Potapov et al., Protein—Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.

Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J . Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.
Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3—Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain

(56) References Cited

OTHER PUBLICATIONS antibody construct, Cancer Immunol Immunother, 2006, vol. 55, pp. 503-514, doi:10.1007/s00262-005-0001-1.
Schoonjans, et al., Fab Chains as an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp. 76-136, 1965, Academic Press.
Senter et al, Proceedings of the American Association for Cancer Research, 2004, vol. 45, Abstract No. 623.
Senter, Potent antibody drug conjugates for cancer therapy, 2009, Current Opin. Chem. Biol. 13:235.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human $\alpha/\beta$ T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.
Shields et al., Lack of fucose on human IgG1 N-linked oligosaccharide improves binding to human Fc$\gamma$RIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Soumyarani et al, Oxidatively modified high density lipoprotein promotes inflammatory response in human monocytes-macrophages by enhanced production of ROS, TNF-$\alpha$, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.

Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tarcsa et al, Chapter 10 Dual-Variable Domain Immunoglobulin (DVD-Ig™) Technology: A Versatile, Novel Format for the Next Generation of Dual-Targeting Biologics, Bispecific Antibodies 2011, pp. 171-185, 2011.
Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, pp. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et. al., Methods for generating multivalent and bispecific antibody fragments, 2000, Methods Enzymol. 326:461-479.
Topp, et al., Targeted Therapy With the T-Cell-Engaging Antibody Blinatumomab of Chemotherapy-Refractory Minimal Residual Disease in B-Lineage Acute Lymphoblastic Leukemia Patients Results in High Response Rate and Prolonged Leukemia-Free Survival, J Clin Oncol vol. 29, No. 18, pp. 2493-2498.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
van Boxel, et al., Some lessons from the systematic production and structural analysis of soluble $\alpha\beta$ T-cell receptors, Journal of Immunological Methods, 2009, vol. 350, pp. 14-21.
van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fc$\gamma$ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.

(56) References Cited

OTHER PUBLICATIONS

Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.

Wang et al., Conserved amino acid networks involved in antibody variable domain interactions, Proteins, 2009, vol. 76, pp. 99-114.

Wang et al., Expression and characterization of recombinant soluble monkey CD3 molecules: mapping the FN18 polymorphic epitope, Molecular Immunology, 2004, vol. 40, pp. 1179-1188.

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Wawrzynczak et al., Methods for preparing immunotoxins: Effect of the linkage on activity and stability. In Immunoconjugates. Antibody Conjugates in Radio imaging and Therapy of Cancer. (C.-W. Vogel, editor). New York, Oxford University Press, pp. 28-55.

Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastation 10 derivative auristatin PHE, 2001, Antimicrob. Agents and Chemother. 45(12):3580-3584.

Wu et al, Molecular construction and optimization of anti-human IL-11α/β dual-variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347,Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi:10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (*Macaca fascicularis*) by using anti-human cross-reactive antibodies, Exp. Anim., 2000, vol. 49(2), pp. 97-100.

Yu et al., The biosynthetic gene cluster of the maytansinoids antitumor agent ansamitocin from actinosynnema pretiosum, 2002, PNAS 99:7968-7973.

Zamyatnin AA., Amino acid, peptide, and protein volume in solution., Annu Rev Biophys Bioeng. 1984;13:145-65.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Ziebig et al., Effect of the oxLDL Binding Protein Fc-CD68 on Plaque Extension and Vulnerability in Atherosclerosis., Circulation Research 108: 695-703, 2011.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zuo, et al., An efficient route to the production of an IgG-like bispecific antibody, Protein Engineering, 2000, vol. 13, No. 5, pp. 361-367.

Szymkowski et al., Creating the next generation of protein therapeutics through rational drug design, Current opinion in drug discovery & development, Sep. 1, 2005, p. 590, XP055354917, England.

Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-9258.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi:10.1016/j.molimm.2008.06.027. Epub Aug. 8, 2008.

Wigginton et al., An immunoglobulin E-reactive chimeric human immunoglobulin G1 anti-idiotype inhibits basophil degranulation through cross-linking of FcɛRI with FcγRIIb., Clinical & Experimental Allergy, 38:313-319.

Zalevsky et al, "Enhanced antibody half-life improves in vivo activity." Nature Biotechnology, vol. 28, No. 2, Feb. 1, 2010, pp. 157-159.

Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.

Krah et al., "Single-domain antibodies for biomedical applications.", Immunopharmacol Immunotoxicol. 2016;38(1):21-8. doi: 10.3109/08923973.2015.1102934. Epub Nov. 9, 2015.

U.S. Appl. No. 12/875,015, Restriction Requirement, dated May 24, 2012.

U.S. Appl. No. 12/875,015, Non-Final Rejection, dated Sep. 17, 2012.

U.S. Appl. No. 12/875,015, Final Rejection, dated May 30, 2013.

U.S. Appl. No. 12/875,015, Non-Final Rejection, dated Dec. 17, 2015.

U.S. Appl. No. 12/875,015, Notice of Allowance, dated Jul. 1, 2016.

U.S. Appl. No. 13/648,951, Restriction Requirement, dated Apr. 23, 2013.

U.S. Appl. No. 13/648,951, Non-Final Rejection, dated Jan. 3, 2014.

(56) References Cited

OTHER PUBLICATIONS

U.S. Appl. No. 13/648,951, Final Rejection, dated Jan. 2, 2015.
U.S. Appl. No. 13/648,951, Non-Final Rejection, dated Feb. 11, 2016.
U.S. Appl. No. 13/648,951, Final Rejection, dated Dec. 15, 2016.
U.S. Appl. No. 13/194,904, Restriction Requirement, dated Sep. 14, 2012.
U.S. Appl. No. 13/194,904, Non-Final Rejection, dated Dec. 14, 2012.
U.S. Appl. No. 13/194,904, Notice of Allowance, dated Sep. 18, 2013.
U.S. Appl. No. 14/165,487, Restriction Requirement, dated Apr. 4, 2016.
U.S. Appl. No. 14/165,487, Notice of Allowance, dated Nov. 8, 2016.
U.S. Appl. No. 13/568,028, Restriction Requirement, dated Sep. 2, 2014.
U.S. Appl. No. 13/568,028, Non-Final Rejection, dated Mar. 12, 2015.
U.S. Appl. No. 14/156,431, Restriction Requirement, dated Mar. 30, 2016.
U.S. Appl. No. 14/156,431, Non-Final Rejection, dated Jun. 23, 2016.
U.S. Appl. No. 14/156,431, Final Rejection, dated Jun. 21, 2017.
U.S. Appl. No. 14/156,432, Restriction Requirement, dated Oct. 6, 2015.
U.S. Appl. No. 14/156,432, Non-Final Rejection, dated Feb. 23, 2016.
U.S. Appl. No. 14/156,432, Non-Final Rejection, dated Aug. 11, 2016.
U.S. Appl. No. 14/155,248, Restriction Requirement, dated Nov. 19, 2015.
U.S. Appl. No. 14/155,248, Non-Final Rejection, dated Jun. 23, 2016.
U.S. Appl. No. 14/155,248, Non-Final Rejection, dated Feb. 3, 2017.
U.S. Appl. No. 14/155,334, Restriction Requirement, dated Nov. 20, 2015.
U.S. Appl. No. 14/155,334, Non-Final Rejection, dated Jun. 22, 2016.
U.S. Appl. No. 14/155,334, Final Rejection, dated Dec. 23, 2016.
U.S. Appl. No. 14/155,334, Non-Final Rejection, dated Jul. 17, 2017.
U.S. Appl. No. 14/155,344, Restriction Requirement, dated Nov. 20, 2015.
U.S. Appl. No. 14/155,344, Non-Final Rejection, dated Sep. 2, 2016.
U.S. Appl. No. 14/205,227, Restriction Requirement, dated Apr. 29, 2015.
U.S. Appl. No. 14/205,227, Non-Final Rejection, dated Sep. 18, 2015.
U.S. Appl. No. 14/205,227, Final Rejection, dated Nov. 25, 2015.
U.S. Appl. No. 14/205,227, Non-Final Rejection, dated May 10, 2016.
U.S. Appl. No. 14/205,248, Restriction Requirement, dated Nov. 20, 2015.
U.S. Appl. No. 14/205,248, Notice of Allowance, dated Jun. 29, 2016.
U.S. Appl. No. 14/205,248, Notice of Allowance, dated Aug. 24, 2016.
U.S. Appl. No. 14/205,248, Notice of Allowance, dated Jan. 20, 2017.
U.S. Appl. No. 14/214,418, Restriction Requirement, dated Mar. 23, 2016.
U.S. Appl. No. 14/214,418, Non-Final Rejection, dated Mar. 14, 2017.
U.S. Appl. No. 14/214,475, Restriction Requirement, dated Sep. 3, 2015.
U.S. Appl. No. 14/214,475, Non-Final Rejection, dated Apr. 7, 2016.
U.S. Appl. No. 14/214,475, Final Rejection, dated Nov. 1, 2016.
U.S. Appl. No. 14/214,475, Non Final Rejection, dated Jun. 2, 2016.
U.S. Appl. No. 14/217,166, Restriction Requirement, dated Aug. 27, 2015.
U.S. Appl. No. 14/217,166, Non-Final Rejection, dated Apr. 20, 2016.
U.S. Appl. No. 14/217,166, Final Rejection, dated Dec. 19, 2016.
U.S. Appl. No. 14/200,652, Restriction Requiremen, dated Dec. 3, 2015.
U.S. Appl. No. 14/200,652, Non-Final Rejection, dated Jun. 30, 2016.
U.S. Appl. No. 14/200,652, Non-Final Rejection, dated Dec. 5, 2016.
U.S. Appl. No. 14/200,652, Non-Final Rejection, dated May 24, 2017.
U.S. Appl. No. 14/207,489, Restriction Requirement, dated Dec. 14, 2015.
U.S. Appl. No. 14/207,489, Non-Final Rejection, dated Aug. 31, 2016.
U.S. Appl. No. 14/207,489, Final Rejection, dated Dec. 29, 2016.
U.S. Appl. No. 14/210,236, Restriction Requirement, dated May 19, 2016.
U.S. Appl. No. 14/210,236, Non-Final Rejection, dated Dec. 15, 2016.
U.S. Appl. No. 14/200,821, Non-Final Rejection, dated Apr. 29, 3015.
U.S. Appl. No. 14/200,821, Final Rejection, dated Feb. 11, 2016.
U.S. Appl. No. 14/200,821, Notice of Allowance, dated Nov. 18, 2016.
U.S. Appl. No. 14/216,705, Restriction Requirement, dated Jun. 30, 2016.
U.S. Appl. No. 14/216,705, Non-Final Rejection, dated Aug. 5, 2016.
U.S. Appl. No. 14/216,705, Final Rejection, dated Mar. 2, 2017.
U.S. Appl. No. 14/424,809, Restriction Requirement, dated Jan. 19, 2017.
U.S. Appl. No. 14/757,809, Non-Final Rejection, dated Jun. 29, 2017.
U.S. Appl. No. 15/063,441, Restriction Requirement, dated Jul. 28, 2017.
WO 2011/028952—PCT/US2010/047741 International Search Report dated Dec. 14, 2010.
WO 2013/055809—PCT/US12/59582 International Search Report dated Mar. 13, 2013.
WO 2012/016227—PCT/US11/46041 International Search Report dated Mar. 15, 2012.
WO 2013/022855—PCT/US12/49789 International Search Report dated Dec. 18, 2012.
WO 2014/113510—PCT/US14/11741 International Search Report dated Jun. 6, 2014.
WO 2016/014984—PCT/US15/42072 International Search Report dated Nov. 4, 2015.
WO 2014/110601—PCT/US14/11549 International Search Report and Written Opinion of the International Searching Authority dated May 7, 2014.
WO 2014/145907—PCT/US14/30758 International Search Report dated Aug. 6, 2014.
WO 2014/145806—PCT/US14/30634 International Search Report dated Jan. 9, 2015.
WO 2015/149077—PCT/US15/23411 International Search Report dated Sep. 2, 2015.
WO 2016/086186—PCT/US15/62769 International Search Report dated Jun. 24, 2016.
WO 2016/086189—PCT/US15/62772 International Search Report dated Jul. 18, 2016.
WO 2016/086196—PCT/US15/62786 62772 International Search Report dated Jun. 22, 2016.
WO 2016/105450—PCT/US15/00155 62772 International Search Report dated Jul. 20, 2016.
WO 2016/141387—PCT/US16/21277 International Search Report dated Jun. 28, 2016.
WO 2016/086189—PCT/US15/62772 International Search Report dated Sep. 6, 2016.

(56) References Cited

OTHER PUBLICATIONS

WO 2017/100372—PCT/US16/65459 International Search Report dated Mar. 27, 2017.
Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.
Chu et al., Immunotherapy with Long-Lived Anti-CD123 x Anti-CD3 Bispecific Antibodies Stimulates Potent T Cell Mediated Killing of Human AML Cell Lines and of CD123+ Cells in Monkeys: A Potential Therapy for Acute Myelogenous Leukemia, Blood 2014, 124:2316.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Kharmate et al., Inhibition of tumor promoting signals by activation of SSTR2 and opioid receptors in human breast cancer cells., Cancer Cell Int. Sep 23, 2013;13(1):93. doi: 10.1186/1475-2867-13-93.

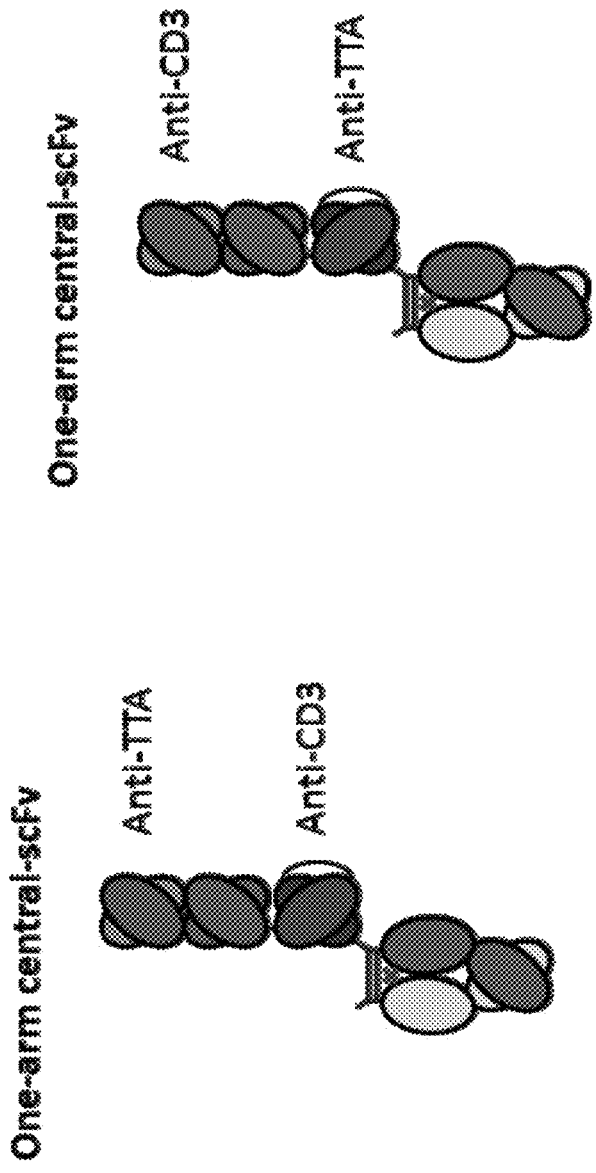

Figure 2

High CD3: Anti-CD3_H1.30_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDSYVSWFAYWGQGTLVTVSS | 1 |
| vhCDR1 | TYAMN | 2 |
| vhCDR2 | RIRSKYNNYATYYADSVKG | 3 |
| vhCDR3 | HGNFGDSYVSWFAY | 4 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 5 |
| vlCDR1 | GSSTGAVTTSNYAN | 6 |
| vlCDR2 | GTNKRAP | 7 |
| vlCDR3 | ALWYSNHWV | 8 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLY LQMNSLRAEDTAVYYCVRHGNFGDSYVSWFAYWGQGTLVTVSSGKPGSGKPGSGKPGSGKPGSQAVVTQEPSLTVSPGGT VTLTCGSSTGAVTTSNYANWVQQKPGKSPRGLIGGTNKRAPGVPARFSGSLLGGKAALTISGAQPEDEADYYCALWYSNHW VFGGGTKLTVL | 9 |

Figure 3

High-Int #1 CD3: Anti-CD3_H1.32_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKANNYATYYADSVKGRFTISRDDSKNTLY LQMNSLRAEDTAVYYCVRHGNFGDSYVSWFAYWGQGTLVTVSS | 10 |
| vhCDR1 | TYAMN | 11 |
| vhCDR2 | RIRSKANNYATYYADSVKG | 12 |
| vhCDR3 | HGNFGDSYVSWFAY | 13 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPE DEADYYCALWYSNHWVFGGGTKLTVL | 14 |
| vlCDR1 | GSSTGAVTTSNYAN | 15 |
| vlCDR2 | GTNKRAP | 16 |
| vlCDR3 | ALWYSNHWV | 17 |
| scFv (including charged linker) | EVQLVESGGGLVQPGGSLRLSCAASGFTFSTYAMNWVRQAPGKGLEWVGRIRSKANNYATYYADSVKGRFTISRDDSKNTLY LQMNSLRAEDTAVYYCVRHGNFGDSYVSWFAYWGQGTLVTVSSGKPGSGKPGSGKPGSQAVVTQEPSLTVSPGGT VTLTCGSSTGAVTTSNYANWVQQKPGKSPRGLIGGTNKRAPGVPARFSGSLLGGKAALTISGAQPEDEADYYCALWYSNHW VFGGGTKLTVL | 18 |

Figure 4

High-Int #2 CD3: Anti-CD3_H1.89_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS | 19 |
| vhCDR1 | TYAMN | 20 |
| vhCDR2 | RIRSKYNNYATYYADSVKG | 21 |
| vhCDR3 | HGNFGDEYVSWFAY | 22 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 23 |
| vlCDR1 | GSSTGAVTTSNYAN | 24 |
| vlCDR2 | GTNKRAP | 25 |
| vlCDR3 | ALWYSNHWV | 26 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 27 |

Figure 5

High-Int #3 CD3: Anti-CD3_H1.90_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS | 28 |
| vhCDR1 | TYAMN | 29 |
| vhCDR2 | RIRSKYNNYATYYADSVKG | 30 |
| vhCDR3 | HGNFGDPYVSWFAY | 31 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 32 |
| vlCDR1 | GSSTGAVTTSNYAN | 33 |
| vlCDR2 | GTNKRAP | 34 |
| vlCDR3 | ALWYSNHWV | 35 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSSGKPGSSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 36 |

Figure 6

Intermediate CD3: Anti-CD3_H1.33_L1.47

| What | sequence | SEQ ID NO: |
|---|---|---|
| Variable heavy (vh) domain | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS | 37 |
| vhCDR1 | TYAMN | 38 |
| vhCDR2 | RIRSKYNNYATYYADSVKG | 39 |
| vhCDR3 | HGNFGDSYVSWFDY | 40 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 41 |
| vlCDR1 | GSSTGAVTTSNYAN | 42 |
| vlCDR2 | GTNKRAP | 43 |
| vlCDR3 | ALWYSNHWV | 44 |
| scFv (including charged linker) | EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 45 |

Figure 7

Low CD3: Anti-CD3_H1.31_L1.47

| What | sequence | SEQ ID NO: |
|---|---|---|
| Variable heavy (vh) domain | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS | 46 |
| vhCDR1 | TYAMS | 47 |
| vhCDR2 | RIRSKYNNYATYYADSVKG | 48 |
| vhCDR3 | HGNFGDSYVSWFAY | 49 |
| Variable light (vl) domain | QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 50 |
| vlCDR1 | GSSTGAVTTSNYAN | 51 |
| vlCDR2 | GTNKRAP | 52 |
| vlCDR3 | ALWYSNHWV | 53 |
| scFv (including charged linker) | EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSSGKPGSSGKPGSSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL | 54 |

Figure 8

High CD38: OKT10_H1.77_L1.24

| What | sequence | SEQ ID NO: |
|---|---|---|
| Variable heavy (vh) domain | EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWGQGTLVTVSS | 55 |
| vhCDR1 | YSWMN | 56 |
| vhCDR2 | EINPQSSTINYATSVKG | 57 |
| vhCDR3 | YGNWFPY | 58 |
| Variable light (vl) domain | DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK | 59 |
| vlCDR1 | RASQNVDTWVA | 60 |
| vlCDR2 | SASYRYS | 61 |
| vlCDR3 | QQYDSYPLT | 62 |
| scFv (including charged linker) | EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWGQGTLVTVSSGKPGSGKPGSGKPGSGKPGSDIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK | 63 |

Figure 9

Intermediate CD38: OKT10_H1L1.24

| What | sequence | SEQ ID NO: |
|---|---|---|
| Variable heavy (vh) domain | EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSS | 64 |
| vhCDR1 | RSWMN | 65 |
| vhCDR2 | EINPDSSTINYATSVKG | 66 |
| vhCDR3 | YGNWFPY | 67 |
| Variable light (vl) domain | DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK | 68 |
| vlCDR1 | RASQNVDTWVA | 69 |
| vlCDR2 | SASYRYS | 70 |
| vlCDR3 | QQYDSYPLT | 71 |
| scFv (including charged linker) | EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSGKPGSGKPGSGKPGSGKPGSDIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK | 72 |

Figure 10

Low CD38: OKT10_H1L1

| What | sequence | SEQ ID NO: |
|---|---|---|
| Variable heavy (vh) domain | EVQLVESGGGLVQPGGSLRLSCAASGFDFSRSWMNWVRQAPGKGLEWVSEINPDSSTINYATSVKGRFTISRDNSKNTLYLQ MNSLRAEDTAVYYCARYGNWFPYWGQGTLVTVSS | 73 |
| vhCDR1 | RSWMN | 74 |
| vhCDR2 | EINPDSSTINYATSVKG | 75 |
| vhCDR3 | YGNWFPY | 76 |
| Variable light (vl) domain | EVQLVESGGGLVQPGGSLRLSCAASGFDFSRSWMNWVRQAPGKGLEWVSEINPDSSTINYATSVKGRFTISRDNSKNTLYLQ MNSLRAEDTAVYYCARYGNWFPYWGQGTLVTVSS | 77 |
| vlCDR1 | RASQNVDTNVA | 78 |
| vlCDR2 | SASYRYS | 79 |
| vlCDR3 | QQYDSYPLT | 80 |
| scFv (including charged linker) | EVQLVESGGGLVQPGGSLRLSCAASGFDFSRSWMNWVRQAPGKGLEWVSEINPDSSTINYATSVKGRFTISRDNSKNTLYLQ MNSLRAEDTAVYYCARYGNWFPYWGQGTLVTVSSGKPGSGKPGSGKPGSEVQLVESGGGLVQPGGSLRLSCAASGF DFSRSWMNWVRQAPGKGLEWVSEINPDSSTINYATSVKGRFTISRDNSKNTLYLQMNSLRAEDTAVYYCARYGNWFPYWG QGTLVTVSS | 81 |

Figure 11

XENP15331

XENP13551 HC-Fab SEQ ID NO:82

EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWG
QGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKALP
APIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQ
KSLSLSPGK

XENP13551 HC-scFv SEQ ID NO:83

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDS
YVSWFAYWGQGTLVTVSSGKPGSGKPGSSGKPGSSGKPGSQAVVTQEPSLTVSPGGTVTLTCGSSTGAVTTSNYANWVQQKPGKSPRGLIGGTNKRAPGVPARFSGSLL
GGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

XENP13551 LC SEQ ID NO:84

DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIKRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 12

XENP13243 HC-Fab SEQ ID NO:85

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKS
CDKTHTCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKAL
PAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYT
QKSLSLSPGK

XENP13243 HC-scFv SEQ ID NO:86

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDS
YVSWFAYWGQGTLVTVSSGKPGSGKPGSSGKPGSGKPGSQAVVTQEPSLTVSPGGTVTLTCGSSTGAVTTSNYANWVQQKPGKSPRGLIGGTNKRAPGVPARFSGSLL
GGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEV
HNAKTKPREEYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

XENP13243 LC SEQ ID NO:87

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 13

XENP14702 Anti-CD38 x Anti-CD3 Fab-scFv-Fc Heavy Chain 1 (Anti-CD38 Fab-Fc (OKT10 H1.77)) SEQ ID NO:88

EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWG
QGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSC
DKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKALP
APIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHEALHNHYTQ
KSLSLSPGK

XENP14702 Anti-CD38 x Anti-CD3 Fab-scFv-Fc Heavy Chain 2 (Anti-CD3 scFv-Fc (αCD3 H1.31 L1.47)) SEQ ID NO:89

EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSY
VSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLG
GKAALTISGAQPEDEAEDYYCALWYSNHWVFGGGTKLTVLEPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK

XENP14702 Anti-CD38 x Anti-CD3 Fab-scFv-Fc Light Chain (Anti-CD38 (OKT10 L1.24)) SEQ ID NO:90

DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIKRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 14

XENP15426 Anti-CD38 (OKT10_H1.77_L1.24, CD38high) x Anti-CD3 (H1.33_L1.47, CD3med) Fab-scFv-Fc HC 1 (Fab-Fc) (SEQ ID NO:91)

EVQLVESGGGLVQPGGSLRLSCAASGFTFSYSWMMNWVRQAPGKGLEWVSEINPQSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMHEALHNHY
TQKSLSLSPGK

HC 2 (scFv-Fc) (SEQ ID NO:92)

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSSGKPGSSGKPGSSGKPGSSGKPGSQAVVTQEPSLTVSPGGTVTLTCGSSTGAVTTSNYANWVQQKPGKSPRGLIGGTNKRAPGVPARFSGS
LLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVVTLPPSREQMTKNQVKLTCLVKGFYPSDIAVEWESNGQPENN
YKTTPPVLDSDGSFFLYSKLTVDKSRWQQGNVFSCSVMHEALHNHYTQKSLSLSPGK

LC (SEQ ID NO:93)

DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 15

XENP14701 Anti-CD38 x Anti-CD3 Fab-scFv-Fc Heavy Chain 1 (Anti-CD38 Fab-Fc (OKT10_H1)) (SEQ ID NO:94)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKS
CDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKLTVDKSRWEQGDVFSCSVMHEALHNHYT
QKSLSLSPGK

XENP14701 Anti-CD38 x Anti-CD3 Fab-scFv-Fc Heavy Chain 2 (Anti-CD3 scFv-Fc (αCD3_H1.31_L1.47)) (SEQ ID NO:95)

EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSY
VSWFAYWGQGTLVTVSSGKPGSGKPGSGKPGSGQAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK

XENP14701 Anti-CD38 x Anti-CD3 Fab-scFv-Fc Light Chain (Anti-CD38 (OKT10_L1)) (SEQ ID NO:96)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 16

XENP14703 Anti-CD38 x Anti-CD3 Fab-scFv-Fc Heavy Chain 1 (Anti-CD38 Fab-Fc (OKT10_H1)) (SEQ ID NO:97)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKS
CDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESDGQPENNYKTTPPVLDSDGSFFLYSKLTVDKSRWQEGNVFSCSVMHEALHNHYT
QKSLSLSPGK

XENP14703 Anti-CD38 x Anti-CD3 Fab-scFv-Fc Heavy Chain 2 (Anti-CD3 scFv-Fc (αCD3_H1.31_L1.47)) (SEQ ID NO:98)

EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSY
VSWFAYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGSLLG
GKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVH
NAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK

XENP14703 Anti-CD38 x Anti-CD3 Fab-scFv-Fc Light Chain (Anti-CD38 (OKT10_L1.53)) (SEQ ID NO:99)

DIVMTQSPSSLSASVGDRVTITCRASQNVDTNVAWYQQKPGQSPKALIYSASYRKSGVPDRFTGSGSGTDFTLTISSLQPEDFATYFCQQYDSYPLTFGGGTKLEIKRTVA
APSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 17

XENP13243 Anti-CD38 (OKT10_H1L1) x Anti-CD3 (H1.30_L1.47) Fab-scFv-Fc

HC 1 (Fab-Fc) (SEQ ID NO:100)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESDGQPENNYKTTPPVLDSDGSFFLYSKLTVDKSRWQEGDVFSCSVMHEALHNHYT
QKSLSLSPGK

HC 2 (scFv-Fc) (SEQ ID NO:101)

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDS
YVSWFAYWGQGTLVTVSSGGGGSGGGGSGGGGSQAVVTQEPSLTVSPGGTVTLTCGSSTGAVTTSNYANWVQQKPGKSPRGLIGGTNKRAPGVPARFSGSLL
GGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

LC (SEQ ID NO:102)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGT/KLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 18

XENP18967 Anti-CD38 (OKT10_H1.77_L1.24) x Anti-CD3 (SP34_H1.32_L1.47) mAb-scFv

HC 1 (SEQ ID NO:103)

EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWG
QGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKS
CDKTHTCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKLTVDKSRWQEGDVFSCSVMHEALHNHYT
QKSLSLSPGK

HC 2 (SEQ ID NO:104)

EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDS
YVSWFAYWGQGTLVTVSS/GKPGSGKPGSGKPGS/QAVVTQEPSLTVSPGGTVTLCGSSTGAVTTSNYANWVQQKPGKSPRGLIGGTNKRAPGVPARFSGS
LLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

LC (SEQ ID NO:105)

DIVMTQSPSSLSASVGDRVTITCRASQNVDTVWAWYQQKPGQSPKALIYSASYRYSGVPDRFTGSGSGTDFTLTISSLQPEDFATYFCQQYDSYPLTFGGGTKLEIK/RTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 19

XENP18971 Anti-CD38 (OKT10_H1L1) x Anti-CD3 (SP34_H1.32_L1.47) mAb-scFv

HC 1 (SEQ ID NO:106)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESDGQPENNYKTTPPVLDSDGSFFLYSKLTVDKSRWQEGDVFSCSVMHEALHNHYT
QKSLSLSPGK

HC 2 (SEQ ID NO:107)

EVQLVESGGGLVQPGGSLRLSCAASGFTFSTYAMNWVRQAPGKGLEWVGRIRSKANNYATYADSVKGRFTISRDDSKNTLYLQMNSLRAEDTAVYYCVRHGNFGDS
YVSWFAYWGQGTLVTVSS/GKPGSGKPGSSGKPGS/QAVVTQEPSLTVSPGGTVTLTCGSSTGAVTTSNYANWVQQKPGKSPRGLIGGTNKRAPGVPARFSGS
LLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

LC (SEQ ID NO:108)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIK/RTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 20

XENP18969 Anti-CD38 (OKT10_H1L1.24) x Anti-CD3 (SP34_H1.33_L1.47) mAb-scFv

HC 1 (SEQ ID NO:109)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKAL
PAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYT
QKSLSLSPGK

HC 2 (SEQ ID NO:110)

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDS
YVSWFDYWGQGTLVTVSS/GKPGSSGKPGSSGKPGS/QAVVTQEPSLTVSPGGTVLTCGSSTGAVTTSNYANWVQQKPGSPRGLIGGTNKRAPGVPARFSGS
LLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

LC (SEQ ID NO:111)

DIVMTQSPSSLSASVGDRVTITCRASQNVDTWVAWYQQKPGKAPKALIYSASYRYSGVPDRFTGSGSGTDFTLTISSLQPEDFATYFCQQYDSYPLITFGGGTKLEIK/RTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 21

XENP18970 Anti-CD38 (OKT10_H1L1.24) x Anti-CD3 (SP34_H1.31_L1.47) mAb-scFv

HC 1 (SEQ ID NO:112)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKAL
PAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYT
QKSLSLSPGK

HC 2 (SEQ ID NO:113)

EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GKPGSGKPGSSGKPGS/QAVVTQEPSLTVSPGGTVTLTCGSSTGAVTTSNYANWVQQKPGKSPRGLIGGTNKRAPGVPARFSGSLL
GGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

LC (SEQ ID NO:114)

DIVMTQSPSSLSASVGDRVTITCRASQNVDTWVAWYQQKPGKAPKALIYSASYRYSGVPDRFTGSGSGTDFTLTISSLQPEDFATYFCQQYDSYPLTFGGGTKLEIK/RTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 22

XENP18972 Anti-CD38 (OKT10_H1L1) x Anti-CD3 (SP34_H1.33_L1.47) mAb-scFv

HC 1 (SEQ ID NO:115)

EVQLVESGGGLVQPGSSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVSHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYT
QKSLSLSPGK

HC 2 (SEQ ID NO:116)

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDS
YVSWFDYWGQGTLVTVSS/GKPGSGKPGSGKPGSGKPGS/QAVVTQEPSLTVSPGGTVTLTCGSSTGAVTTSNYANWVQQKPGKSPRGLIGGTNKRAPGVPARFSGS
LLGGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

LC (SEQ ID NO:117)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIK/RTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 23

XENP18973 Anti-CD38 (OKT10_H1L1) x Anti-CD3 (SP34_H1.31_L1.47) mAb-scFv

HC 1 (SEQ ID NO:118)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSS/ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKAL
PAPIEKTISKAKGQPREPQVYTLPPSREEMTKNQVSLTCLVKGFYPSDIAVEWESDGQPENNYKTTPPVLDSDGSFFLYSKLTVDKSRWEQGDVFSCSVMHEALHNHYT
QKSLSLSPGK

HC 2 (SEQ ID NO:119)

EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSY
VSWFAYWGQGTLVTVSS/GKPGSGKPGSGKPGS/QAVVTQEPSLTVSPGGTVLTCGSSTGAVTTSNYANWVQQKPGKSPRGLIGGTNKRAPGVPARFSGSLL
GGKAALTISGAQPEDEADYYCALWYSNHWVFGGGTKLTVL/EPKSSDKTHTCPPCPAPPVAGPSVFLFPPKPKDTLMISRTPEVTCVVVDVKHEDPEVKFNWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

LC (SEQ ID NO:120)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIK/RTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 24

XENP15055 Anti-CD38 (OKT10_H1L1, CD38low) x Anti-CD3 (H1.33_L1.47, CD3med) Fab-scFv-Fc HC 1 (Fab-Fc) (SEQ ID NO:121)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCLVKGFYPSDIAVEWESDGQPENNYKTTPPVLDSDGSFFLYSKLTVDKSRWQQGNVFSCSVMHEALHNHY
TQKSLSLSPGK

HC 2 (scFv-Fc) (SEQ ID NO:122)

EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGD
SYVSWFDYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGS
LLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGV
EVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENN
YKTTPPVLDSDGSFFLYSKLTVDKSRWQQGNVFSCSVMHEALHNHYTQKSLSLSPGK

LC (SEQ ID NO:123)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 25

XENP13544 Anti-CD38 (OKT10_H1L1, CD38low) x Anti-CD3 (H1.79_L1.48) Fab-scFv-Fc

HC 1 (Fab-Fc) (SEQ ID NO:124)

EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVKHEDPEVKFNWYVDGVEVHNAKTKPREEYNSTYRVVSVLTVLHQDWLNGKEYKCKVSNKA
LPAPIEKTISKAKGQPREPQVYTLPPSREEMTKNQVSLTCDVSGFYPSDIAVEWESDGQPENNYKTTPPVLDSDGSFFLYSKLTVDKSRWQEGDVFSCSVMHEALHNHY
TQKSLSLSPGK

HC 2 (scFv-Fc) (SEQ ID NO:125)

EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDS
YVSWFAYWGQGTLVTVSSGKPGSGKPGSGKPGSGKPGSQAVVTQEPSLTVSPGGTVTLCGSSTGAVTTSNYANWVQQKPGKSPRGLIGGTNKRAPGVPARFSGSL
LGGKAALTISGAQPEDEADYYCALWYSNHWVFGCGTKLTVLEPKSSDKTHTCPPCPAPPVAGPSVFLFPPKPKDTLMISRTPEVTCVVVDVKHEDPEVKFNWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

LC (SEQ ID NO:126)

DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 26

XENP13694 Anti-CD38 (OKT10_H1.77_L1.24, CD38high) x Anti-CD3 (H1.79_L1.48) Fab-scFv-Fc HC 1 (Fab-Fc) (SEQ ID NO:127)

EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYW
GQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPK
SCDKTHTCPPCPAPPVAGPSVFLFPPKPKDTLMISRTPEVTCVVVDVSHEDPEVKFNWYVDGVEVHNAKTKPREEEYNSTYRVVSVLTVLHQDWLNGKEYKCKVSNKA
LPAPIEKTISKAKGQPREPQVYTLPPSREEMTKNQVSLTCLVKGFYPSDIAVEWESDGQPENNYKTTPPVLDSDGSFFLYSKLTVDKSRWQEGDVFSCSVMHEALHNHY
TQKSLSLSPGK

HC 2 (scFv-Fc) (SEQ ID NO:128)

EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDS
YVSWFAYWGQGTLVTVSSGKPGSGKPGSGKPGSQAVVTQEPSLTVSPGGTVTLTCGSSTGAVTTSNYANWVQQKPGKSPRGLIGGTNKRAPGVPARFSGSL
LGGKAALTISGAQPEDEADYYCALWYSNHWVFGCGTKLTVLEPKSSDKTHTCPPCPAPPVAGPSVFLFPPKPKDTLMISRTPEVTCVVVDVKHEDPEVKFNWYVDGVE
VHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNY
KTTPPVLDSDGSFFLYSKLTVDKSRWQQGNVFSCSVMHEALHNHYTQKSLSLSPGK

LC (SEQ ID NO:129)

DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIKRTV
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

Figure 27

>sp|P07766|CD3E_HUMAN T-cell surface glycoprotein CD3 epsilon chain (SEQ ID NO:130)

MQSGTHWRVLGLCLLSVGVWGQDGNEEMGGITQTPYKVSISGTTVILTCPQYPGSEILWQ

HNDKNIGGDEDDKNIGSDEDHLSLKEFSELEQSGYYVCYPRGSKPEDANFYLYLRARVCE

NCMEMDVMSVATIVIVDICITGGLLLLVYYWSKNRKAKAKPVTRGAGAGGRQRGQNKERP

PPVPNPDYEPIRKGQRDLYSGLNQRRI

Figure 28

Human CD38 sequence, "/" indicates the junction with the extracellular domain (ECD)

(SEQ ID NO:131)

MANCEFSPVSGDKPCCRLSRRAQLCLGVSILVLILVVVLAVV/VPRWRQQWSGPGTTKRFP

ETVLARCVKYTEIHPEMRHVDCQSVWDAFKGAFISKHPCNITEEDYQPLMKLGTQTVPCN

KILLWSRIKDLAHQFTQVQRDMFTLEDTLLGYLADDLTWCGEFNTSKINYQSCPDWRKDC

SNNPVSVFWKTVSRRFAEAACDVVHVMLNGSRSKIFDKNSTFGSVEVHNLQPEKVQTLEA

WVIHGGREDSRDLCQDPTIKELESIISKRNIQFSCKNIYRPDKFLQCVKNPEDSSCTSEI

ECD domain (SEQ ID NO:132)

VPRWRQQWSGPGTTKRFPETVLARCVKYTEIHPEMRHVDCQSVWDAFKGAFISKHPCNITEEDYQPLMKLGTQTVPC
NKILLWSRIKDLAHQFTQVQRDMFTLEDTLLGYLADDLTWCGEFNTSKINYQSCPDWRKDC

SNNPVSVFWKTVSRRFAEAACDVVHVMLNGSRSKIFDKNSTFGSVEVHNLQPEKVQTLEA

WVIHGGREDSRDLCQDPTIKELESIISKRNIQFSCKNIYRPDKFLQCVKNPEDSSCTSEI

Figure 29A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 29B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 29C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 29D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 29E

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| I199T N203D K274Q R355Q N384S K392N V397M Q419E DEL447 | |
| N208D Q295E N384D Q418E N421D | |
| N208D Q295E Q418E N421D | |
| Q196K I199T P217R P228R N276K | |
| Q196K I199T N276K | |
| E269Q E272Q E283Q E357Q | |
| E269Q E272Q E283Q | |
| E269Q E272Q | |
| E269Q E283Q | |
| E272Q E283Q | |
| E269Q | |

Figure 30 pI variants

| Variant constant region | Substitutions |
|---|---|
| pI_ISO(-) | I199T N203D K274Q R355Q N384S K392N V397M Q419E DEL447 |
| pI_(-)_isosteric_A | N208D Q295E N384D Q418E N421D |
| pI_(-)_isosteric_B | N208D Q295E Q418E N421D |
| pI_ISO(+RR) | Q196K I199T P217R P228R N276K |
| pI_ISO(+) | Q196K I199T N276K |
| pI_(+)_isosteric_A | E269Q E272Q E283Q E357Q |
| pI_(+)_isosteric_B | E269Q E272Q E283Q |
| pI_(+)_isosteric_E269Q/E272Q | E269Q E272Q |
| pI_(+)_isosteric_E269Q/E283Q | E269Q E283Q |
| pI_(+)_isosteric_E272Q/E283Q | E272Q E283Q |
| pI_(+)_isosteric_E269Q | E269Q |

Figure 31 Ablation variants

| Variant | Variant(s), cont. |
|---|---|
| G236R | P329K |
| S239G | A330L |
| S239K | A330S/P331S |
| S239Q | I332K |
| S239R | I332R |
| V266D | V266D/A327Q |
| S267K | V266D/P329K |
| S267R | S267R/A327Q |
| H268K | S267R/P329K |
| E269R | G236R/L328R |
| 299R | E233P/L234V/L235A/G236del/S239K |
| 299K | E233P/L234V/L235A/G236del/S267K |
| K322A | E233P/L234V/L235A/G236del/S239K/A327G |
| A327G | E233P/L234V/L235A/G236del/S267K/A327G |
| A327L | E233P/L234V/L235A/G236del |
| A327N | S239K/S267K |
| A327Q | 267K/P329K |
| L328E | |
| L328R | |
| P329A | |
| P329H | |

Figure 32

| scFv monomer (+) | Fab monomer (-) |
|---|---|
| Heterodimer pI variants S364K/E357Q | Heterodimerization pI variants L368D/K370S |
| Optional scFv charged linker including but not limited to (GKPGS)$_4$ (SEQ ID NOS 142 & 158) | Isosteric pI substitutions N208D/Q295E/N384D/Q418E/N421D |
| FcKO E233P/L234V/L235A/G236del/S267K | FcKO E233P/L234V/L235A/G236del/S267K |
| ± 428L/434S for FcRn | ± 428L/434S for FcRn |
| scFv of anti-CD3 | Fv sequences for anti-CD38 |

| scFv monomer | Fab monomer |
|---|---|
| Heterodimer pI variants S364K/E357Q | Heterodimerization pI variants L368D/K370S |
| Optional scFv charged linker including, but not limited to (GKPGS)$_4$ (SEQ ID NOS 142 & 158) | pI substitutions I199T N203D K274Q R355Q Q419E K447del |
| FcKO E233P/L234V/L235A/G236del/S267K | FcKO E233P/L234V/L235A/G236del/S267K |
| ± 428L/434S for FcRn (optional) | ± 428L/434S for FcRn (optional) |
| scFv of anti-CD3 | scFv of anti-CD38 |

Figure 33A

Positive charged scFv linkers

| Name | Sequence | Length | Charge | SEQ ID NO: |
|---|---|---|---|---|
| Gly-Ser 15 | GGGGSGGGGSGGGGS | 15 | 0 | 133 |
| Whitlow linker | GSTSGSGKPGSGEGSTKG | 18 | +1 | 134 |
| 6paxA_1 (+A) | IRPRAIGGSKPRVA | 14 | +4 | 135 |
| +B | GKGGSGKGGSGKGGS | 15 | +3 | 136 |
| +C | GGKGSGGKGSGGKGS | 15 | +3 | 137 |
| +D | GGGKSGGGKSGGGKS | 15 | +3 | 138 |
| +E | GKGKSGKGKSGKGKS | 15 | +6 | 139 |
| +F | GGGKSGGKGSGKGGS | 15 | +3 | 140 |
| +G | GKPGSGKPGSGKPGS | 15 | +3 | 141 |
| +H | GKPGSGKPGSGKPGSGKPGS | 20 | +4 | 142 |
| +I | GKGKSGKGKSGKGKSGKGKS | 20 | +8 | 143 |

Negative charged scFv linkers

| Name | Sequence | Length | Charge | SEQ ID NO: |
|---|---|---|---|---|
| Gly-Ser 15 | GGGGSGGGGSGGGGSGGGGS | 20 | 0 | 144 |
| 3hsc_2 (-A) | STAGDTHLGGEDFD | 14 | -4 | 145 |
| -B | GEGGSGEGGSGEGGS | 15 | -3 | 146 |
| -C | GGEGSGGEGSGGEGS | 15 | -3 | 147 |
| -D | GGGESGGGESGGGES | 15 | -3 | 148 |
| -E | GEGESGEGESGEGES | 15 | -6 | 149 |
| -F | GGGESGGEGSGEGGS | 15 | -3 | 150 |
| -G | GEGESGEGESGEGESGEGES | 20 | -8 | 151 |

Figure 33B scFv Linkers

| | |
|---|---|
| GGGGSGGGGSGGGGS | (SEQ ID NO:152) |
| GGGGSGGGGSGGGGSGGGGS | (SEQ ID NO:153) |
| GSTSGSGKPGSGEGSTKG | (SEQ ID NO:154) |
| PRGASKSGSASQTGSAPGS | (SEQ ID NO:155) |
| GTAAAGAGAAGGAAAGAAG | (SEQ ID NO:156) |
| GTSGSSGSGSGGSGSGGGG | (SEQ ID NO:157) |
| GKPGSGKPGSGKPGSGKPGS | (SEQ ID NO:158) |

Figure 34

| XENP | Heterodimer-skewing variant, Chain 1 | Heterodimer-skewing variant, Chain 2 | Heterodimer Yield (%) | CH3 Tm (°C) |
|---|---|---|---|---|
| 12757 | none | none | 52.7 | 83.1 |
| 12758 | L368D/K370S | S364K | 94.4 | 76.6 |
| 12759 | L368D/K370S | S364K/E357L | 90.2 | 77.2 |
| 12760 | L368D/K370S | S364K/E357Q | 95.2 | 77.5 |
| 12761 | T411E/K360E/Q362E | D401K | 85.6 | 80.6 |
| 12496 | L368E/K370S | S364K | 91.5 | n.d. |
| 12511 | K370S | S364K | 59.9 | n.d. |
| 12840 | L368E/K370S | S364K/E357Q | 59.5 | n.d. |
| 12841 | K370S | S364K/E357Q | 90.4 | n.d. |
| 12894 | L368E/K370S | S364K | 41.0 | n.d. |
| 12895 | K370S | S364K | 49.3 | n.d. |
| 12896 | L368E/K370S | S364K/E357Q | 73.9 | n.d. |
| 12901 | K370S | S364K/E357Q | 87.9 | n.d. |

Figure 39

XENP14419 Anti-CD38 (OKT10_H1L1) x Anti-CD3 (H1.30_L1.47) mAb-scFv

HC 1 (SEQ ID NO:159)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:160)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGS/EVQLVESG
GGLVQPGGSLRLSCAASGFTFS<u>TYAMN</u>WVRQAPGKGLEWVG<u>RIRSKYNNYATYYADSVKG</u>RFTISRDDSKNTLYLQM
NSLRAEDTAVYYCVR<u>HGNFGDSYVSWFAY</u>WGQGTLVTVSSGKPGSGKPGSGKPGSGKPGSQAVVTQEPSLTVSPGGT
VTLTC<u>GSSTGAVTTSNYAN</u>WVQQKPGKSPRGLIG<u>GTNKRAP</u>GVPARFSGSLLGGKAALTISGAQPEDEADYYC<u>ALWYS
NHWV</u>FGGGTKLTVL

LC (SEQ ID NO:161)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGT/KLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 40

XENP14420 Anti-CD38 (OKT10_H1L1) x Anti-CD3 (H1.30_L1.47) mAb-Fv

HC 1 (SEQ ID NO:162)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGKGGGGSGGGGSGGGGS/EVQLVESGG
GLVQPGGSLRLSCAASGFTFS<u>TYAMN</u>WVRQAPGKGLEWVG<u>RIRSKYNNYATYYADSVKG</u>RFTISRDDSKNTLYLQMN
SLRAEDTAVYYCVR<u>HGNFGDSYVSWFAY</u>WGQGTLVTVSS

HC 2 (SEQ ID NO:163)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGS/QAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDEA
DYYC<u>ALWYSNHWV</u>FGGGTKLTVL

LC (SEQ ID NO:164)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGT/KLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 41

XENP14421 Anti-CD38 (OKT10_H1L1) x Anti-CD3 (H1.30_L1.47) central-scFv

HC 1 (SEQ ID NO:165)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:166)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGS/EVQLV
ESGGGLVQPGGSLRLSCAASGFTFSTYAMNWVRQAPGKGLEWVGRIRSKYNNYATYYADSVKGRFTISRDDSKNTLYL
QMNSLRAEDTAVYYCVRHGNFGDSYVSWFAYWGQGTLVTVSSGKPGSGKPGSGKPGSGKPGSQAVVTQEPSLTVSP
GGTVTLTCGSSTGAVTTSNYANWVQQKPGKSPRGLIGGTNKRAPGVPARFSGSLLGGKAALTISGAQPEDEADYYCAL
WYSNHWVFGGGTKLTVL/GGGGSGGGGSKTHTCPPCPAPPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREPQVY
TLPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO:167)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGT/KLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 42

XENP14422 Anti-CD38 (OKT10_H1L1) x Anti-CD3 (H1.30_L1.47) one-arm central-scFv

HC 1 (SEQ ID NO:168)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:169)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGS/EVQLV
ESGGGLVQPGGSLRLSCAASGFTFS<u>TYAMN</u>WVRQAPGKGLEWVG<u>RIRSKYNNYATYYADSVKG</u>RFTISRDDSKNTLYL
QMNSLRAEDTAVYYCVR<u>HGNFGDSYVSWFAY</u>WGQGTLVTVSSGKPGSGKPGSGKPGSGKPGSQAVVTQEPSLTVSP
GGTVTLTC<u>GSSTGAVTTSNYAN</u>WVQQKPGKSPRGLIG<u>GTNKRAP</u>GVPARFSGSLLGGKAALTISGAQPEDEADYYC<u>AL
WYSNHWV</u>FGGGTKLTVL/GGGGSGGGGSKTHTCPPCPAPPVAGPSVFLFPPKPKDTLMISRTPEVTCVVVDVKHEDP
EVKFNWYVDGVEVHNAKTKPREEQYNSTYRVVSVLTVLHQDWLNGKEYKCKVSNKALPAPIEKTISKAKGQPREPQVY
TLPPSREMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO:170)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGT/KLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 43

XENP14423 Anti-CD38 (OKT10_H1L1) x Anti-CD3 (H1.30_L1.47) central-Fv

HC 1 (SEQ ID NO:171)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCGGGGSGGGGS/EVQLV
ESGGGLVQPGGSLRLSCAASGFTFS<u>TYAMN</u>WVRQAPGKGLEWVG<u>RIRSKYNNYATYYADSVKG</u>RFTISRDDSKNTLYL
QMNSLRAEDTAVYYCVR<u>HGNFGDSYVSWFAY</u>WGQGTLVTVSS/GGGGSGGGGSKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYKCK
VSNKALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

HC 2 (SEQ ID NO:172)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGS/QAVV
TQEPSLTVSPGGTVTLTC<u>GSSTGAVTTSNYAN</u>WVQQKPGKSPRGLIG<u>GTNKRAP</u>GVPARFSGSLLGGKAALTISGAQPE
DEADYYC<u>ALWYSNHWV</u>FGGGTKLTVL/GGGGSGGGGSKTHTCPPCPAPPVAGPSVFLFPPKPKDTLMISRTPEVTCVV
VDVKHEDPEVKFNWYVDGVEVHNAKTKPREEQYNSTYRVVSVLTVLHQDWLNGKEYKCKVSNKALPAPIEKTISKAKG
QPREPQVYTLPPSREQMTKNQVKLTCLVKGFYPSDIAVEWESNGQPENNYKTTPPVLDSDGSFFLYSKLTVDKSRWQQ
GNVFSCSVMHEALHNHYTQKSLSLSPGK

LC (SEQ ID NO:173)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGT/KLEIKRTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 52

XENP15427 Anti-CD38 (OKT10_H1L1) x Anti-CD3 (H1.31_L1.47) one-arm mAb-scFv

HC 1 (SEQ ID NO:174)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:175)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGSEVQLVESG
GGLVQPGGSLRLSCAASGFTFS<u>TYAMS</u>WVRQAPGKGLEWVG<u>RIRSKYNNYATYYADSVKG</u>RFTISRDDSKNTLYLQM
NSLRAEDTAVYYCVR<u>HGNFGDSYVSWFAY</u>WGQGTLVTVSSGKPGSGKPGSGKPGSGKPGSQAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYC<u>ALWYS
NHWV</u>FGGGTKLTVL

LC (SEQ ID NO:176)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 53

XENP15428 Anti-CD38 (OKT10_H1L1) x Anti-CD3 (H1.33_L1.47) one-arm mAb-scFv

HC 1 (SEQ ID NO:177)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:178)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGSEVQLVESG
GGLVQPGGSLRLSCAASGFTFSTYAMNWVRQAPGKGLEWVGRIRSKYNNYATYYADSVKGRFTISRDDSKNTLYLQM
NSLRAEDTAVYYCVRHGNFGDSYVSWFDYWGQGTLVTVSSGKPGSGKPGSGKPGSGKPGSQAVVTQEPSLTVSPGGT
VTLTCGSSTGAVTTSNYANWVQQKPGKSPRGLIGGTNKRAPGVPARFSGSLLGGKAALTISGAQPEDEADYYCALWYS
NHWVFGGGTKLTVL

LC (SEQ ID NO:179)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 54

XENP15429 Anti-CD38 (OKT10_H1L1) x Anti-CD3 (H1.30_L1.47) one-arm mAb-scFv

HC 1 (SEQ ID NO:180)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:181)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGSEVQLVESG
GGLVQPGGSLRLSCAASGFTFSTYAMNWVRQAPGKGLEWVGRIRSKYNNYATYYADSVKGRFTISRDDSKNTLYLQM
NSLRAEDTAVYYCVRHGNFGDSYVSWFAYWGQGTLVTVSSGKPGSGKPGSGKPGSGKPGSQAVVTQEPSLTVSPGGT
VTLTCGSSTGAVTTSNYANWVQQKPGKSPRGLIGGTNKRAPGVPARFSGSLLGGKAALTISGAQPEDEADYYCALWYS
NHWVFGGGTKLTVL

LC (SEQ ID NO:182)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 55

XENP15430 Anti-CD38 (OKT10_H1L1) x Anti-CD3 (H1.31_L1.47) one-arm central-scFv

HC 1 (SEQ ID NO:183)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:184)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGSEVQLVE
SGGGLVQPGGSLRLSCAASGFTFSTYAMSWVRQAPGKGLEWVGRIRSKYNNYATYYADSVKGRFTISRDDSKNTLYLQ
MNSLRAEDTAVYYCVRHGNFGDSYVSWFAYWGQGTLVTVSSGKPGSGKPGSGKPGSGKPGSQAVVTQEPSLTVSPG
GTVTLTCGSSTGAVTTSNYANWVQQKPGKSPRGLIGGTNKRAPGVPARFSGSLLGGKAALTISGAQPEDEADYYCALW
YSNHWVFGGGTKLTVLGGGGSGGGGSKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

LC (SEQ ID NO:185)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 56

XENP15431 Anti-CD38 (OKT10_H1L1) x Anti-CD3 (H1.33_L1.47) one-arm central-scFv

HC 1 (SEQ ID NO:186)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:187)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGSEVQLVE
SGGGLVQPGGSLRLSCAASGFTFS<u>TYAMS</u>WVRQAPGKGLEWVG<u>RIRSKYNNYATYYADSVKG</u>RFTISRDDSKNTLYLQ
MNSLRAEDTAVYYCVR<u>HGNFGDSYVSWFAY</u>WGQGTLVTVSSGKPGSGKPGSGKPGSGKPGSQAVVTQEPSLTVSPG
GTVTLTC<u>GSSTGAVTTSNYAN</u>WVQQKPGKSPRGLIGG<u>TNKRAP</u>GVPARFSGSLLGGKAALTISGAQPEDEADYYC<u>ALW
YSNHWV</u>FGGGTKLTVLGGGGSGGGGSKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

LC (SEQ ID NO:188)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 57

XENP15432 Anti-CD38 (OKT10_H1L1) x Anti-CD3 (H1.30_L1.47) one-arm central-scFv

HC 1 (SEQ ID NO:189)

EPKSSDKTHTCPPCPAPPVAGPSVFLFPPKPKDTLMISRTPEVTCVVVDVKHEDPEVKFNWYVDGVEVHNAKTKPREEE
YNSTYRVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

HC 2 (SEQ ID NO:190)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGSEVQLVE
SGGGLVQPGGSLRLSCAASGFTFS<u>TYAMN</u>WVRQAPGKGLEWVG<u>RIRSKYNNYATYYADSVKG</u>RFTISRDDSKNTLYLQ
MNSLRAEDTAVYYCVR<u>HGNFGDSYVSWFAY</u>WGQGTLVTVSSGKPGSGKPGSGKPGSGKPGSQAVVTQEPSLTVSPG
GTVTLTC<u>GSSTGAVTTSNYAN</u>WVQQKPGKSPRGL<u>IGGTNKRAP</u>GVPARFSGSLLGGKAALTISGAQPEDEADYYC<u>ALW
YSNHWV</u>FGGGTKLTVLGGGGSGGGGSKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

LC (SEQ ID NO:191)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 58

XENP15433 Anti-CD38 (OKT10_H1L1) x Anti-CD3 (H1.31_L1.47) mAb-scFv

HC 1 (SEQ ID NO:192)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:193)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGSEVQLVESG
GGLVQPGGSLRLSCAASGFTFS<u>TYAMS</u>WVRQAPGKGLEWVG<u>RIRSKYNNYATYYADSVKG</u>RFTISRDDSKNTLYLQM
NSLRAEDTAVYYCVR<u>HGNFGDSYVSWFAY</u>WGQGTLVTVSSGKPGSGKPGSGKPGSGKPGSQAVVTQEPSLTVSPGGT
VTLTC<u>GSSTGAVTTSNYAN</u>WVQQKPGKSPRGLIG<u>GTNKRAP</u>GVPARFSGSLLGGKAALTISGAQPEDEADYYC<u>ALWYS
NHWV</u>FGGGTKLTVL

LC (SEQ ID NO:194)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 59

XENP15434 Anti-CD38 (OKT10_H1L1) x Anti-CD3 (H1.33_L1.47) mAb-scFv

HC 1 (SEQ ID NO:195)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:196)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGSEVQLVESG
GGLVQPGGSLRLSCAASGFTFS<u>TYAMN</u>WVRQAPGKGLEWVGR<u>IRSKYNNYATYYADSVKG</u>RFTISRDDSKNTLYLQM
NSLRAEDTAVYYCVR<u>HGNFGDSYVSWFDY</u>WGQGTLVTVSSGKPGSGKPGSGKPGSGKPGSQAVVTQEPSLTVSPGGT
VTLTC<u>GSSTGAVTTSNYAN</u>WVQQKPGKSPRGLIGG<u>TNKRAP</u>GVPARFSGSLLGGKAALTISGAQPEDEADYYC<u>ALWYS
NHWV</u>FGGGTKLTVL

LC (SEQ ID NO:197)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 60

XENP15435 Anti-CD38 (OKT10_H1L1) x Anti-CD3 (H1.30_L1.47) mAb-scFv

HC 1 (SEQ ID NO:198)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:199)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGKGGGGSGGGGSGGGGSEVQLVESG
GGLVQPGGSLRLSCAASGFTFS<u>TYAMN</u>WVRQAPGKGLEWVG<u>RIRSKYNNYATYYADSVKG</u>RFTISRDDSKNTLYLQM
NSLRAEDTAVYYCVR<u>HGNFGDSYVSWFAY</u>WGQGTLVTVSSGKPGSGKPGSGKPGSGKPGSQAVVTQEPSLTVSPGGT
VTLTC<u>GSSTGAVTTSNYAN</u>WVQQKPGKSPRGLI<u>GGTNKRAP</u>GVPARFSGSLLGGKAALTISGAQPEDEADYYC<u>ALWYS
NHWV</u>FGGGTKLTVL

LC (SEQ ID NO:200)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 61

XENP15436 Anti-CD38 (OKT10_H1L1) x Anti-CD3 (H1.31_L1.47) central-scFv

HC 1 (SEQ ID NO:201)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:202)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGSEVQLVE
SGGGLVQPGGSLRLSCAASGFTFSTYAMSWVRQAPGKGLEWVGRIRSKYNNYATYYADSVKGRFTISRDDSKNTLYLQ
MNSLRAEDTAVYYCVRHGNFGDSYVSWFAYWGQGTLVTVSSGKPGSGKPGSGKPGSGKPGSQAVVTQEPSLTVSPG
GTVTLTCGSSTGAVTTSNYANWVQQKPGKSPRGLIGGTNKRAPGVPARFSGSLLGGKAALTISGAQPEDEADYYCALW
YSNHWVFGGGTKLTVLGGGGSGGGGSKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

LC (SEQ ID NO:203)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 62

XENP15437 Anti-CD38 (OKT10_H1L1) x Anti-CD3 (H1.33_L1.47) central-scFv

HC 1 (SEQ ID NO:204)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:205)

EVQLVESGGGLVQPGGSLRLSCAASGFDFS<u>RSWMN</u>WVRQAPGKGLEWVS<u>EINPDSSTINYATSVKG</u>RFTISRDNSKNT
LYLQMNSLRAEDTAVYYCAR<u>YGNWFPY</u>WGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGSEVQLVE
SGGGLVQPGGSLRLSCAASGFTFS<u>TYAMS</u>WVRQAPGKGLEWVG<u>RIRSKYNNYATYYADSVKG</u>RFTISRDDSKNTLYLQ
MNSLRAEDTAVYYCVR<u>HGNFGDSYVSWFAY</u>WGQGTLVTVSSGKPGSGKPGSGKPGSGKPGSQAVVTQEPSLTVSPG
GTVTLTC<u>GSSTGAVTTSNYAN</u>WVQQKPGKSPRGLIG<u>GTNKRAP</u>GVPARFSGSLLGGKAALTISGAQPEDEADYYC<u>ALW
YSNHWV</u>FGGGTKLTVLGGGGSGGGGSKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

LC (SEQ ID NO:206)

DIVMTQSPSSLSASVGDRVTITC<u>RASQNVDTNVA</u>WYQQKPGQSPKALIY<u>SASYRYS</u>GVPDRFTGSGSGTDFTLTISSLQP
EDFATYFC<u>QQYDSYPLT</u>FGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 63

XENP15438 Anti-CD38 (OKT10_H1L1) x Anti-CD3 (H1.30_L1.47) central-scFv

HC 1 (SEQ ID NO:207)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSDTKVDKKVEPKSCDKTHTCPPCPAPPVAG
PSVFLFPPKPKDTLMISRTPEVTCVVVDVKHEDPEVKFNWYVDGVEVHNAKTKPREEEYNSTYRVVSVLTVLHQDWLN
GKEYKCKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

HC 2 (SEQ ID NO:208)

EVQLVESGGGLVQPGGSLRLSCAASGFDFSRSWMNWVRQAPGKGLEWVSEINPDSSTINYATSVKGRFTISRDNSKNT
LYLQMNSLRAEDTAVYYCARYGNWFPYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCGGGGSGGGGSEVQLVE
SGGGLVQPGGSLRLSCAASGFTFSTYAMNWVRQAPGKGLEWVGRIRSKYNNYATYYADSVKGRFTISRDDSKNTLYLQ
MNSLRAEDTAVYYCVRHGNFGDSYVSWFAYWGQGTLVTVSSGKPGSGKPGSGKPGSGKPGSQAVVTQEPSLTVSPG
GTVTLTCGSSTGAVTTSNYANWVQQKPGKSPRGLIGGTNKRAPGVPARFSGSLLGGKAALTISGAQPEDEADYYCALW
YSNHWVFGGGTKLTVLGGGSGGGGSKTHTCPPCPAPPVAGPSVFLFPPKPKDTLMISRTPEVTCVVVDVKHEDPEVK
FNWYVDGVEVHNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQGNVFSCSVMH
EALHNHYTQKSLSLSPGK

LC (SEQ ID NO:209)

DIVMTQSPSSLSASVGDRVTITCRASQNVDTNVAWYQQKPGQSPKALIYSASYRYSGVPDRFTGSGSGTDFTLTISSLQP
EDFATYFCQQYDSYPLTFGGGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 64

| XENP | CD38 affinity | αCD3 scFv-Fc | $K_D$ (nM)* | Fold Decrease in CD3 binding from H1.30_L1.47 |
|---|---|---|---|---|
| 13243 | low | H1.30_L1.47 | 4.91 | 1 |
| 14701 | low | H1.31_L1.47 | 1640 | 330 |
| 14702 | high | H1.31_L1.47 | 1640 | 330 |
| 14703 | v. low | H1.31_L1.47 | 1640 | 330 |

Figure 65

| Pool | DNA amount (%) | | | XENP13243 Heterodimer (%) | XENP13551 Heterodimer (%) |
|---|---|---|---|---|---|
| | Light chain | HC1 (Fab-Fc) | HC2 (scFv-Fc) | | |
| A | 47.4 | 31.6 | 21.1 | 65.6 | 57.6 |
| B | 42.9 | 28.6 | 28.6 | 61.2 | 83.5 |
| C | 37.5 | 25.0 | 37.5 | 96.2 | 90.5 |
| D | 33.3 | 22.2 | 44.4 | 92.8 | 84.4 |
| E | 54.5 | 27.3 | 18.2 | -- | 65.7 |
| F | 50.0 | 25.0 | 25.0 | 93.0 | 91.1 |
| G | 44.4 | 22.2 | 33.3 | 85.7 | 89.6 |
| H | 40.0 | 20.0 | 40.0 | 95.0 | 100.0 |

Figure 67A

| VH ID | VL ID | VH Substitutions | VL Substitutions |
|---|---|---|---|
| H1 | L1.4 | | |
| H1.30 | L1.47 | N30S/N100D | Q42K/A43S/L75I/E85D/L95H |
| H1.33 | L1.47 | N30S/N100D/A101D | Q42K/A43S/L75I/E85D/L95H |
| H1.31 | L1.47 | N30S/N35S/N100D | Q42K/A43S/L75I/E85D/L95H |
| H1.32 | L1.47 | N30S/Y52CA/N100D | Q42K/A43S/L75I/E85D/L95H |
| H1.88 | L1.47 | N30S/N100P | Q42K/A43S/L75I/E85D/L95H |
| H1.89 | L1.47 | N30S/N100D/S100AE | Q42K/A43S/L75I/E85D/L95H |
| H1.90 | L1.47 | N30S/N100D/S100AP | Q42K/A43S/L75I/E85D/L95H |
| H1.91 | L1.47 | N30S/Y52CA/N100D | Q42K/A43S/L75I/E85D/L95H |
| H1.92 | L1.47 | N30S/Y58A/N100D | Q42K/A43S/L75I/E85D/L95H |
| H1.93 | L1.47 | N30S/N100E | Q42K/A43S/L75I/E85D/L95H |
| H1.94 | L1.47 | N30S/N100Q | Q42K/A43S/L75I/E85D/L95H |
| H1.96 | L1.47 | N30S/N100D/S100AN | Q42K/A43S/L75I/E85D/L95H |
| H1.97 | L1.47 | N30S/N100D/S100AQ | Q42K/A43S/L75I/E85D/L95H |
| H1.98 | L1.47 | N30S/Y52CA/N100D/A101D | Q42K/A43S/L75I/E85D/L95H |
| H1.99 | L1.47 | N30S/Y58A/N100D/A101D | Q42K/A43S/L75I/E85D/L95H |
| H1.100 | L1.47 | N30S/N100A/A101D | Q42K/A43S/L75I/E85D/L95H |
| H1.101 | L1.47 | N30S/N100Q/A101D | Q42K/A43S/L75I/E85D/L95H |
| H1.102 | L1.47 | N30S/N100D/S100AE/A101D | Q42K/A43S/L75I/E85D/L95H |
| H1.103 | L1.47 | N30S/N100D/S100AN/A101D | Q42K/A43S/L75I/E85D/L95H |
| H1.104 | L1.47 | N30S/N100D/S100AP/A101D | Q42K/A43S/L75I/E85D/L95H |
| H1.105 | L1.47 | N30S/N100D/S100AQ/A101D | Q42K/A43S/L75I/E85D/L95H |

Figure 67B

| VH ID | VL ID | VH Substitutions | VL Substitutions |
|---|---|---|---|
| H1.106 | L1.47 | N30S/Y52CA/Y58A/N100D | Q42K/A43S/L75I/E85D/L95H |
| H1.107 | L1.47 | N30S/Y52CA/Y58A/N100A | Q42K/A43S/L75I/E85D/L95H |
| H1.108 | L1.47 | N30S/Y52CA/Y58A/N100Q | Q42K/A43S/L75I/E85D/L95H |
| H1.109 | L1.47 | N30S/Y52CA/Y58A/N100D/A101D | Q42K/A43S/L75I/E85D/L95H |

Figure 68A: anti-CD3 sequences

H1_L1.4

SEQ ID NO:210

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:211

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:212

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS

SEQ ID NO:213

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:214

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:215

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:216

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFAYWGQGTLVTVSS

SEQ ID NO:217

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:218

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:219

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:220

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDSYVSWFDYWGQGTLVTVSS

SEQ ID NO:221

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:222

EVQLVESGGGLVQPGGSLRLSCAASGFTFSTYAMSWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:223

EVQLVESGGGLVQPGGSLRLSCAASGFTFSTYAMSWVRQAPGKGLEWVGRIRSKYNNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:224

EVQLVESGGGLVQPGGSLRLSCAASGFTFSTYAMSWVRQAPGKGLEWVGRIRSKYNNYATYYADSVKGRFTISRDDS
KNTLYLQMNSLRAEDTAVYYCVRHGNFGDSYVSWFAYWGQGTLVTVSS

SEQ ID NO:225

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:226

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:227

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:228

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS

SEQ ID NO:229

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:230

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGPSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:231

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGPSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:232

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGPSYVSWFAYWGQGTLVTVSS

SEQ ID NO:233

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:234

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDEYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO:235

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDEYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO:236

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDEYVSWFAY</u>WGQGTLVTVSS

SEQ ID NO:237

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO:238

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDPYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:239

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDPYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:240

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDPYVSWFAYWGQGTLVTVSS

SEQ ID NO:241

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:242

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:243

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:244

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSS

SEQ ID NO:245

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:246

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:247

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:248

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSS

SEQ ID NO:249

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:250

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGESYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO:251

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGESYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO:252

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGESYVSWFAYWGQGTLVTVSS

SEQ ID NO:253

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO:254

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGQSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO:255

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGQSYVSWFAY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO:256

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGQSYVSWFAY</u>WGQGTLVTVSS

SEQ ID NO: 257

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 258

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 259

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 260

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFAYWGQGTLVTVSS

SEQ ID NO: 261

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 262

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDQYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 263

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDQYVSWFAYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 264

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDQYVSWFAYWGQGTLVTVSS

SEQ ID NO: 265

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 266

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 267

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 268

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFDYWGQGTLVTVSS

SEQ ID NO: 269

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 270

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 271

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 272

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFDYWGQGTLVTVSS

SEQ ID NO: 273

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 274

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGASYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 275

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGASYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 276

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGASYVSWFDYWGQGTLVTVSS

SEQ ID NO: 277

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 278

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGQSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 279

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGQSYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 280

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGQSYVSWFDY</u>WGQGTLVTVSS

SEQ ID NO: 281

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 282

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 283

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 284

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDEYVSWFDYWGQGTLVTVSS

SEQ ID NO: 285

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 286

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVLGSHHHHHH

SEQ ID NO: 287

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFDYWGQGTLVTVSSGKPGSGKPGSGKPGSGKPGSQAVVTQE
PSLTVSPGGTVTLTCGSSTGAVTTSNYANWVQQKPGKSPRGLIGGTNKRAPGVPARFSGSLLGGKAALTISGAQPEDE
ADYYCALWYSNHWVFGGGTKLTVL

SEQ ID NO: 288

EVQLVESGGGLVQPGGSLRLSCAASGFTFSTYAMNWVRQAPGKGLEWVGRIRSKYNNYATYYADSVKGRFTISRDDS
KNTLYLQMNSLRAEDTAVYYCVRHGNFGDNYVSWFDYWGQGTLVTVSS

SEQ ID NO: 289

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 290

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDPYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 291

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDPYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 292

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDPYVSWFDY</u>WGQGTLVTVSS

SEQ ID NO: 293

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 294

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDQYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVLGSHHHHHH

SEQ ID NO: 295

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDQYVSWFDY</u>WGQGTLVTVSSGKPGSGKPGSGKPGSGKPGSQAVVTQE
PSLTVSPGGTVTLTC<u>GSSTGAVTTSNYAN</u>WVQQKPGKSPRGLIG<u>GTNKRAP</u>GVPARFSGSLLGGKAALTISGAQPEDE
ADYYC<u>ALWYSNHWV</u>FGGGTKLTVL

SEQ ID NO: 296

EVQLVESGGGLVQPGGSLRLSCAASGFTFS<u>TYAMN</u>WVRQAPGKGLEWVG<u>RIRSKYNNYATYYADSVKG</u>RFTISRDDS
KNTLYLQMNSLRAEDTAVYYCVR<u>HGNFGDQYVSWFDY</u>WGQGTLVTVSS

SEQ ID NO: 297

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 298

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVLGSHHHHHH

SEQ ID NO: 299

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVL

SEQ ID NO: 300

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGDSYVSWFAY</u>WGQGTLVTVSS

SEQ ID NO: 301

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 302

EVQLVESGGGLVQPGGSLRLSCAASGFTFSTYAMNWVRQAPGKGLEWVGRIRSKANNYATAYADSVKGRFTISRDD
SKNTLYLQMNSLRAEDTAVYYCVRHGNFGASYVSWFAYWGQGTLVTVSSGKPGSGKPGSGKPGSGKPGSQAVVTQ
EPSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLGSHHHHHH

SEQ ID NO: 303

EVQLVESGGGLVQPGGSLRLSCAASGFTFSTYAMNWVRQAPGKGLEWVGRIRSKANNYATAYADSVKGRFTISRDD
SKNTLYLQMNSLRAEDTAVYYCVRHGNFGASYVSWFAYWGQGTLVTVSSGKPGSGKPGSGKPGSGKPGSQAVVTQ
EPSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL

SEQ ID NO: 304

EVQLVESGGGLVQPGGSLRLSCAASGFTFSTYAMNWVRQAPGKGLEWVGRIRSKANNYATAYADSVKGRFTISRDD
SKNTLYLQMNSLRAEDTAVYYCVRHGNFGASYVSWFAYWGQGTLVTVSS

SEQ ID NO: 305

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

SEQ ID NO: 306

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGQSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVLGSHHHHHH

SEQ ID NO: 307

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGQSYVSWFAY</u>WGQGTLVTVSSGKPGSGKPGSGKPGSGKPGSQAVVTQ
EPSLTVSPGGTVTLTC<u>GSSTGAVTTSNYAN</u>WVQQKPGKSPRGLIG<u>GTNKRAP</u>GVPARFSGSLLGGKAALTISGAQPED
EADYYC<u>ALWYSNHWV</u>FGGGTKLTVL

SEQ ID NO: 308

EVQLVESGGGLVQPGGSLRLSCAASGFTFS<u>TYAMN</u>WVRQAPGKGLEWVG<u>RIRSKANNYATAYADSVKG</u>RFTISRDD
SKNTLYLQMNSLRAEDTAVYYCVR<u>HGNFGQSYVSWFAY</u>WGQGTLVTVSS

SEQ ID NO: 309

QAVVTQEPSLTVSPGGTVTLTC<u>GSSTGAVTTSNYAN</u>WVQQKPGKSPRGLIG<u>GTNKRAP</u>GVPARFSGSLLGGKAALTIS
GAQPEDEADYYC<u>ALWYSNHWV</u>FGGGTKLTVL

SEQ ID NO: 310

EVQLVESGGGLVQPGGSLRLSCAASGFTFSTYAMNWVRQAPGKGLEWVGRIRSKANNYATAYADSVKGRFTISRDD
SKNTLYLQMNSLRAEDTAVYYCVRHGNFGDSYVSWFDYWGQGTLVTVSSGKPGSGKPGSGKPGSGKPGSQAVVTQ
EPSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVLGSHHHHHH

SEQ ID NO: 311

EVQLVESGGGLVQPGGSLRLSCAASGFTFSTYAMNWVRQAPGKGLEWVGRIRSKANNYATAYADSVKGRFTISRDD
SKNTLYLQMNSLRAEDTAVYYCVRHGNFGDSYVSWFDYWGQGTLVTVSSGKPGSGKPGSGKPGSGKPGSQAVVTQ
EPSLTVSPGGTVTLTCGSSTGAVTTSNYANWVQQKPGKSPRGLIGGTNKRAPGVPARFSGSLLGGKAALTISGAQPED
EADYYCALWYSNHWVFGGGTKLTVL

SEQ ID NO: 312

EVQLVESGGGLVQPGGSLRLSCAASGFTFSTYAMNWVRQAPGKGLEWVGRIRSKANNYATAYADSVKGRFTISRDD
SKNTLYLQMNSLRAEDTAVYYCVRHGNFGDSYVSWFDYWGQGTLVTVSS

SEQ ID NO: 313

QAVVTQEPSLTVSPGGTVTLTCGSSTGAVTTSNYANWVQQKPGKSPRGLIGGTNKRAPGVPARFSGSLLGGKAALTIS
GAQPEDEADYYCALWYSNHWVFGGGTKLTVL

Figure 69
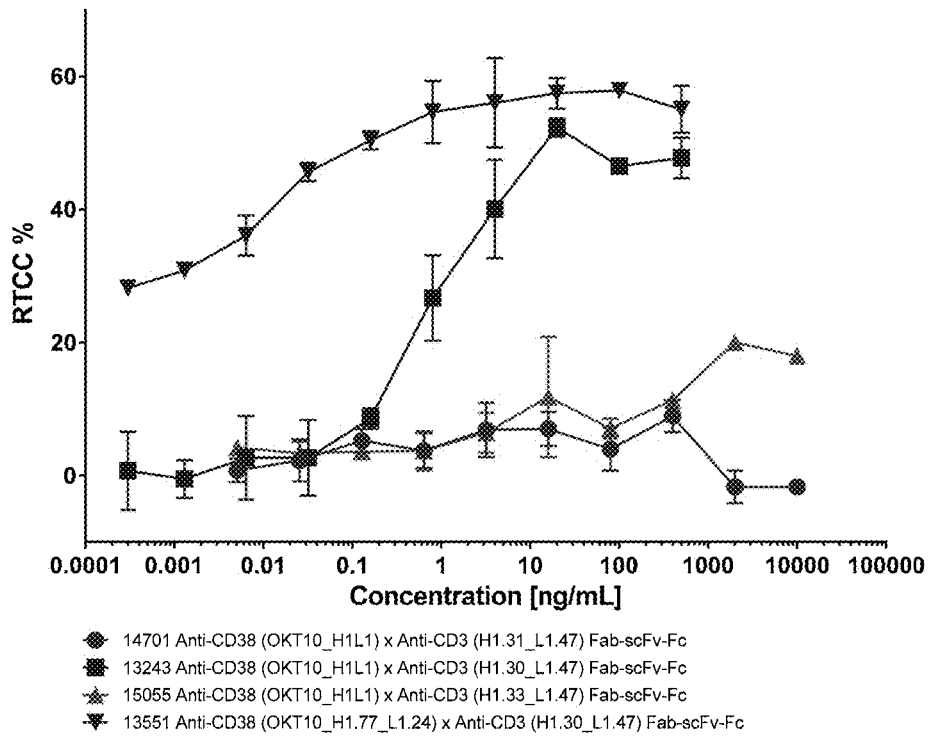
- 14701 Anti-CD38 (OKT10_H1L1) x Anti-CD3 (H1.31_L1.47) Fab-scFv-Fc
- 13243 Anti-CD38 (OKT10_H1L1) x Anti-CD3 (H1.30_L1.47) Fab-scFv-Fc
- 15055 Anti-CD38 (OKT10_H1L1) x Anti-CD3 (H1.33_L1.47) Fab-scFv-Fc
- 13551 Anti-CD38 (OKT10_H1.77_L1.24) x Anti-CD3 (H1.30_L1.47) Fab-scFv-Fc
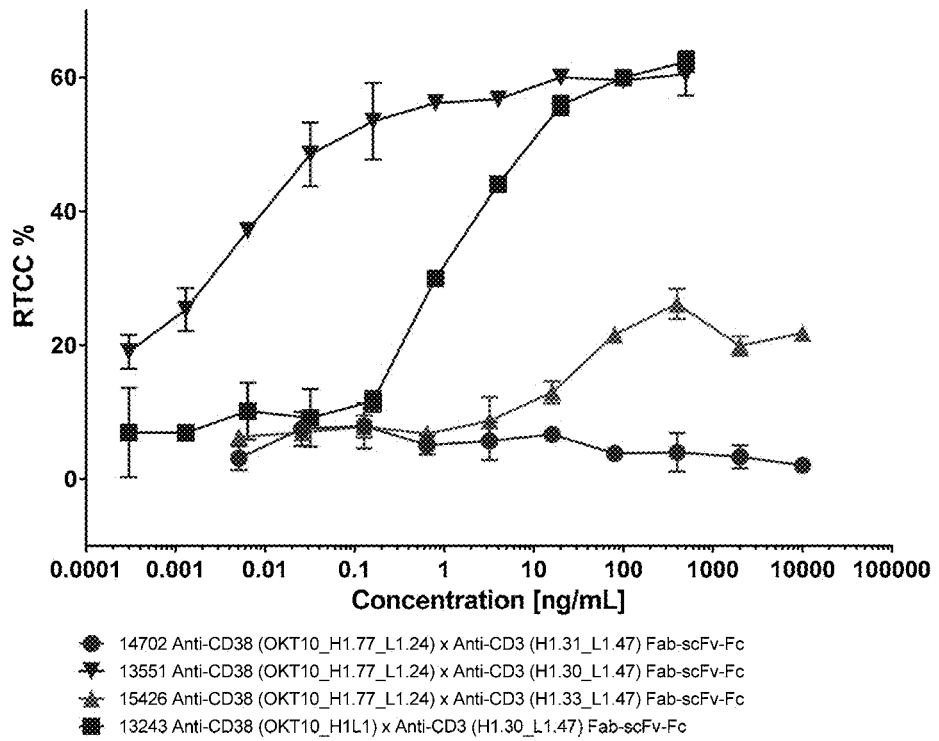
- 14702 Anti-CD38 (OKT10_H1.77_L1.24) x Anti-CD3 (H1.31_L1.47) Fab-scFv-Fc
- 13551 Anti-CD38 (OKT10_H1.77_L1.24) x Anti-CD3 (H1.30_L1.47) Fab-scFv-Fc
- 15426 Anti-CD38 (OKT10_H1.77_L1.24) x Anti-CD3 (H1.33_L1.47) Fab-scFv-Fc
- 13243 Anti-CD38 (OKT10_H1L1) x Anti-CD3 (H1.30_L1.47) Fab-scFv-Fc

Figure 71

XENP15049 Anti-CD19 (4G7_H1.227_L1.199) x Anti-CD3 (H1.30_L1.47) Fab-scFv-Fc

HC 1 (Fab-Fc) (SEQ ID NO: 314)

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

HC 2 (scFv-Fc) (SEQ ID NO: 315)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 316)

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 72

XENP15051 Anti-CD19 (4G7_H1.227_L1.199) x Anti-CD3 (H1.31_L1.47) Fab-scFv-Fc

HC 1 (Fab-Fc) (SEQ ID NO: 317)

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

HC 2 (scFv-Fc) (SEQ ID NO: 318)

EVQLVESGGGLVQPGGSLRLSCAASGFTFSTYAMSWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 319)

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 73

XENP15050 Anti-CD19 (4G7_H1.227_L1.199) x Anti-CD3 (H1.33_L1.47) Fab-scFv-Fc

HC 1 (Fab-Fc) (SEQ ID NO: 320)

EVQLVESGGGLVKPGGSLKLSCAASGYTFTSYVMHWVRQAPGGGLEWIGYINPYNDGTKYNEKFKGRVTISSDKSKST
AYMELSSLRSEDTAVYYCARGTYYYGTRVFDYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK

HC 2 (scFv-Fc) (SEQ ID NO: 321)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 322)

DIVMTQSPATLSLSPGERATISCRSSKSLQNVNGNTYLYWFQQKPGQSPKLLIYRASNLNSGVPDRFSGSGSGTEFTLTIS
SLEPEDFAVYYCMQHLEYPITFGGGTKLEIKRTVAAPSVFIFPPSDEQLKSGTASVVCLLNNFYPREAKVQWKVDNALQS
GNSQESVTEQDSKDSTYSLSSTLTLSKADYEKHKVYACEVTHQGLSSPVTKSFNRGEC

Figure 74

XENP13676 Anti-CD20 (C2B8_H1L1) x Anti-CD3 (H1.30_L1.47) Fab-scFv-Fc

HC 1 (Fab-Fc) (SEQ ID NO: 323)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 324)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 325)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 75

XENP14696 Anti-CD20 (C2B8_H1L1) x Anti-CD3 (H1.31_L1.47) Fab-scFv-Fc

HC 1 (Fab-Fc) (SEQ ID NO: 326)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 327)

EVQLVESGGGLVQPGGSLRLSCAASGFTFSTYAMSWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 328)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 76

XENP15629 Anti-CD20 (C2B8_H1L1) x Anti-CD3 (H1.32_L1.47) Fab-scFv-Fc

HC 1 (Fab-Fc) (SEQ ID NO: 329)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 330)

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 331)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 77

XENP15053 Anti-CD20 (C2B8_H1L1) x Anti-CD3 (H1.33_L1.47) Fab-scFv-Fc

HC 1 (Fab-Fc) (SEQ ID NO: 332)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 333)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 334)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 78

XENP15630 Anti-CD20 (C2B8_H1L1) x Anti-CD3 (H1.88_L1.47) Fab-scFv-Fc

HC 1 (Fab-Fc) (SEQ ID NO: 335)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 336)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGPSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 337)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 79

XENP15631 Anti-CD20 (C2B8_H1L1) x Anti-CD3 (H1.89_L1.47) Fab-scFv-Fc

HC 1 (Fab-Fc) (SEQ ID NO: 338)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 339)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDEYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 340)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 80

XENP15632 Anti-CD20 (C2B8_H1L1) x Anti-CD3 (H1.90_L1.47) Fab-scFv-Fc

HC 1 (Fab-Fc) (SEQ ID NO: 341)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 342)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDPYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 343)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 81

XENP15633 Anti-CD20 (C2B8_H1L1) x Anti-CD3 (H1.91_L1.47) Fab-scFv-Fc

HC 1 (Fab-Fc) (SEQ ID NO: 344)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 345)

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 346)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 82

XENP15634 Anti-CD20 (C2B8_H1L1) x Anti-CD3 (H1.92_L1.47) Fab-scFv-Fc

HC 1 (Fab-Fc) (SEQ ID NO: 347)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 348)

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFAYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 349)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 83

XENP15635 Anti-CD20 (C2B8_H1L1) x Anti-CD3 (H1.93_L1.47) Fab-scFv-Fc

HC 1 (Fab-Fc) (SEQ ID NO: 350)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 351)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGESYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 352)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 84

XENP15636 Anti-CD20 (C2B8_H1L1) x Anti-CD3 (H1.94_L1.47) Fab-scFv-Fc

HC 1 (Fab-Fc) (SEQ ID NO: 353)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 354)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGQSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 355)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 85

XENP15638 Anti-CD20 (C2B8_H1L1) x Anti-CD3 (H1.95_L1.47) Fab-scFv-Fc

HC 1 (Fab-Fc) (SEQ ID NO: 356)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 357)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDEYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 358)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 86

XENP15639 Anti-CD20 (C2B8_H1L1) x Anti-CD3 (H1.96_L1.47) Fab-scFv-Fc

HC 1 (Fab-Fc) (SEQ ID NO: 359)

QVQLVQSGAEVKKPGASVKVSCKASGYTFTSYNMHWVRQAPGQGLEWMGAIYPGNGDTSYNQKFQGRVTITADKSI
STAYMELSSLRSEDTAVYYCARSTYYGGDWYFNVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 360)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDQYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 361)

QIVLTQSPSSLSASVGDRVTITCRASSSVSYIHWFQQKPGKSPKPLIYATSNLASGVPVRFSGSGSGTDYTLTISSLQPEDF
ATYYCQQWTSNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 87

XENP13677 Anti-CD20 (C2B8_H1.202_L1.113) x Anti-CD3 (H1.30_L1.47) Fab-scFv-Fc

HC 1 (Fab-Fc) (SEQ ID NO: 362)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 363)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 364)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 88

XENP14388 Anti-CD20 (C2B8_H1.202_L1.113) x Anti-CD3 (H1.31_L1.47) Fab-scFv-Fc

HC 1 (Fab-Fc) (SEQ ID NO: 365)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 366)

EVQLVESGGGLVQPGGSLRLSCAASGFTFSTYAMSWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 367)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 89

XENP14389 Anti-CD20 (C2B8_H1.202_L1.113) x Anti-CD3 (H1.32_L1.47) Fab-scFv-Fc

HC 1 (Fab-Fc) (SEQ ID NO: 368)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 369)

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFAYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 370)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 90

XENP14390 Anti-CD20 (C2B8_H1.202_L1.113) x Anti-CD3 (H1.33_L1.47) Fab-scFv-Fc

HC 1 (Fab-Fc) (SEQ ID NO: 371)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 372)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFDYWGQGTLVTVSSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 373)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 91

XENP14391 Anti-CD20 (C2B8_H1.202_L1.113) x Anti-CD3 (H1.88_L1.47) Fab-scFv-Fc

HC 1 (Fab-Fc) (SEQ ID NO: 374)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 375)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGPSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREEMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 376)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 92

XENP14392 Anti-CD20 (C2B8_H1.202_L1.113) x Anti-CD3 (H1.89_L1.47) Fab-scFv-Fc

HC 1 (Fab-Fc) (SEQ ID NO: 377)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 378)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDEYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 379)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 93

XENP14393 Anti-CD20 (C2B8_H1.202_L1.113) x Anti-CD3 (H1.90_L1.47) Fab-scFv-Fc

HC 1 (Fab-Fc) (SEQ ID NO: 380)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 381)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDPYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 382)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 94

XENP16366 Anti-CD20 (C2B8_H1.202_L1.113) x Anti-CD3 (H1.98_L1.47) Fab-scFv-Fc

HC 1 (Fab-Fc) (SEQ ID NO: 383)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 384)

EVQLVESGGGLVQPGGSLRLSCAASGFTFSTYAMNWVRQAPGKGLEWVGRIRSKANNYATYYADSVKGRFTISRDDS
KNTLYLQMNSLRAEDTAVYYCVRHGNFGDSYVSWFDYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 385)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 95

XENP16367 Anti-CD20 (C2B8_H1.202_L1.113) x Anti-CD3 (H1.99_L1.47) Fab-scFv-Fc

HC 1 (Fab-Fc) (SEQ ID NO: 386)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 387)

EVQLVESGGGLVQPGGSLRLSCAASGFTFSTYAMNWVRQAPGKGLEWVGRIRSKYNNYATAYADSVKGRFTISRDDS
KNTLYLQMNSLRAEDTAVYYCVRHGNFGDSYVSWFDYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 388)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 96

XENP16368 Anti-CD20 (C2B8_H1.202_L1.113) x Anti-CD3 (H1.100_L1.47) Fab-scFv-Fc

HC 1 (Fab-Fc) (SEQ ID NO: 389)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 390)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGASYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 391)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 97

XENP16369 Anti-CD20 (C2B8_H1.202_L1.113) x Anti-CD3 (H1.101_L1.47) Fab-scFv-Fc

HC 1 (Fab-Fc) (SEQ ID NO: 392)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 393)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGQSYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 394)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 98

XENP16370 Anti-CD20 (C2B8_H1.202_L1.113) x Anti-CD3 (H1.102_L1.47) Fab-scFv-Fc

HC 1 (Fab-Fc) (SEQ ID NO: 395)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 396)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDEYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 397)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 99

XENP16371 Anti-CD20 (C2B8_H1.202_L1.113) x Anti-CD3 (H1.103_L1.47) Fab-scFv-Fc

HC 1 (Fab-Fc) (SEQ ID NO: 398)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 399)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDNYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 400)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 100

XENP16372 Anti-CD20 (C2B8_H1.202_L1.113) x Anti-CD3 (H1.104_L1.47) Fab-scFv-Fc

HC 1 (Fab-Fc) (SEQ ID NO: 401)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 402)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDPYVSWFDYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK

LC (SEQ ID NO: 403)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 101

XENP16373 Anti-CD20 (C2B8_H1.202_L1.113) x Anti-CD3 (H1.105_L1.47) Fab-scFv-Fc

HC 1 (Fab-Fc) (SEQ ID NO: 404)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 405)

EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDQYVSWFDYWGQGTLVTVSSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 406)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 102

XENP16374 Anti-CD20 (C2B8_H1.202_L1.113) x Anti-CD3 (H1.106_L1.47) Fab-scFv-Fc

HC 1 (Fab-Fc) (SEQ ID NO: 407)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 408)

EVQLVESGGGLVQPGGSLRLSCAASGFTFSTYAMNWVRQAPGKGLEWVGRIRSKANNYATAYADSVKGRFTISRDDS
KNTLYLQMNSLRAEDTAVYYCVRHGNFGDSYVSWFAYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 409)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 103

XENP16375 Anti-CD20 (C2B8_H1.202_L1.113) x Anti-CD3 (H1.107_L1.47) Fab-scFv-Fc

HC 1 (Fab-Fc) (SEQ ID NO: 410)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 411)

EVQLVESGGGLVQPGGSLRLSCAASGFTFSTYAMNWVRQAPGKGLEWVGRIRSKANNYATAYADSVKGRFTISRDDS
KNTLYLQMNSLRAEDTAVYYCVRHGNFGASYVSWFAYWGQGTLVTVSSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 412)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 104

XENP16376 Anti-CD20 (C2B8_H1.202_L1.113) x Anti-CD3 (H1.108_L1.47) Fab-scFv-Fc

HC 1 (Fab-Fc) (SEQ ID NO: 413)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVSHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 414)

EVQLVESGGGLVQPGGSLRLSCAASGFTFSTYAMNWVRQAPGKGLEWVGRIRSKANNYATAYADSVKGRFTISRDDS
KNTLYLQMNSLRAEDTAVYYCVRHGNFGQSYVSWFAYWGQGTLVTVSSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 415)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 105

Anti-CD20 (C2B8_H1.202_L1.113) x Anti-CD3 (H1.109_L1.47) Fab-scFv-Fc

HC 1 (Fab-Fc) (SEQ ID NO: 416)

QVQLVQSGAEVKKPGASVKVSCKASGYTFTSYNMHWVRQAPGQRLEWMGAIYPGNGATSYSQKFQGRVTITADTSA
STAYMELSSLRSEDTAVYYCARSYYMGGDWYFDVWGAGTLVTVSSASTKGPSVFPLAPSSKSTSGGTAALGCLVKDYFP
EPVTVSWNSGALTSGVHTFPAVLQSSGLYSLSSVVTVPSSSLGTQTYICNVNHKPSDTKVDKKVEPKSCDKTHTCPPCPA
PPVAGPSVFLFPPKPKDTLMISRTPEVTCVVVDVKHEDPEVKFNWYVDGVEVHNAKTKPREEEYNSTYRVVSVLTVLHQ
DWLNGKEYKCKVSNKALPAPIEKTISKAKGQPREPQVYTLPPSREEMTKNQVSLTCDVSGFYPSDIAVEWESDGQPEN
NYKTTPPVLDSDGSFFLYSKLTVDKSRWEQGDVFSCSVMHEALHNHYTQKSLSLSPGK

HC 2 (scFv-Fc) (SEQ ID NO: 417)

EVQLVESGGGLVQPGGSLRLSCAASGFTFSTYAMNWVRQAPGKGLEWVGRIRSKANNYATAYADSVKGRFTISRDDS
KNTLYLQMNSLRAEDTAVYYCVRHGNFGDSYVSWFDYWGQGTLVTVSSGKPGSGKPGSGKPGSGKPGSQAVVTQEP
SLTVSPGGTVTLTCGSSTGAVTTSNYANWVQQKPGKSPRGLIGGTNKRAPGVPARFSGSLLGGKAALTISGAQPEDEA
DYYCALWYSNHWVFGGGTKLTVLEPKSSDKTHTCPPCPAPPVAGPSVFLFPPKPKDTLMISRTPEVTCVVVDVKHEDPE
VKFNWYVDGVEVHNAKTKPREEQYNSTYRVVSVLTVLHQDWLNGKEYKCKVSNKALPAPIEKTISKAKGQPREPQVYT
LPPSREQMTKNQVKLTCLVKGFYPSDIAVEWESNGQPENNYKTTPPVLDSDGSFFLYSKLTVDKSRWQQGNVFSCSV
MHEALHNHYTQKSLSLSPGK

LC (SEQ ID NO: 418)

QIVLTQSPSSLSASVGDRVTITCRASWSVSYIHWFQQKPGKSPKPLIYATSNLASGVPVRFSGSGSGTDYTLTISSLQPEDF
ATYYCQQWTHNPPTFGGGTKVEIKRTVAAPSVFIFPPSDEQLKSGTASVVCLLNNFYPREAKVQWKVDNALQSGNSQE
SVTEQDSKDSTYSLSSTLTLSKADYEKHKVYACEVTHQGLSSPVTKSFNRGEC

Figure 106

>sp|P11836|CD20_HUMAN B-lymphocyte antigen CD20

SEQ ID NO: 419

MTTPRNSVNGTFPAEPMKGPIAMQSGPKPLFRRMSSLVGPTQSFFMRESKTLGAVQIMNG

LFHIALGGLLMIPAGIYAPICVTVWYPLWGGIMYIISGSLLAATEKNSRKCLVKGKMIMN

SLSLFAAISGMILSIMDILNIKISHFLKMESLNFIRAHTPYINIYNCEPANPSEKNSPST

QYCYSIQSLFLGILSVMLIFAFFQELVIAGIVENEWKRTCSRPKSNIVLLSAEEKKEQTI

EIKEEVVGLTETSSQPKNEEDIEIIPIQEEEEEETETNFPEPPQDQESSPIENDSSP

>sp|P26951|IL3RA_HUMAN Interleukin-3 receptor subunit alpha (CD123)

SEQ ID NO: 420

MVLLWLTLLLIALPCLLQTKEDPNPPITNLRMKAKAQQLTWDLNRNVTDIECVKDADYSM

PAVNNSYCQFGAISLCEVTNYTVRVANPPFSTWILFPENSGKPWAGAENLTCWIHDVDFL

SCSWAVGPGAPADVQYDLYLNVANRRQQYECLHYKTDAQGTRIGCRFDDISRLSSGSQSS

HILVRGRSAAFGIPCTDKFVVFSQIEILTPPNMTAKCNKTHSFMHWKMRSHFNRKFRYEL

QIQKRMQPVITEQVRDRTSFQLLNPGTYTVQIRARERVYEFLSAWSTPQRFECDQEEGAN

TRAWRTSLLIALGTLLALVCVFVICRRYLVMQRLFPRIPHMKDPIGDSFQNDKLVVWEAG

KAGLEECLVTEVQVVQKT

Figure 111
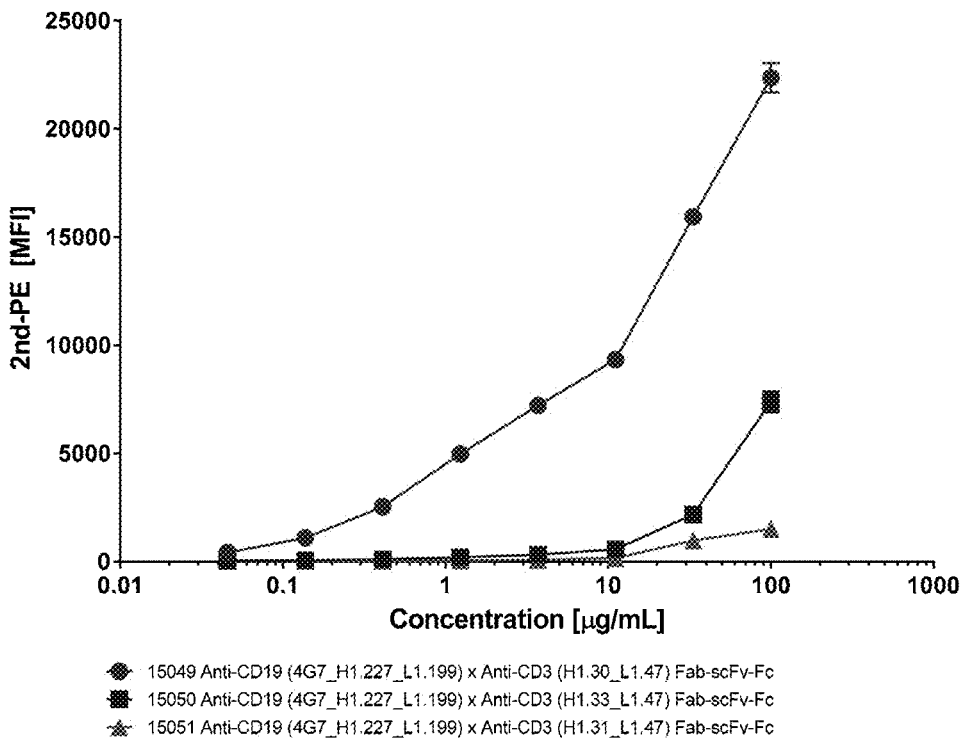
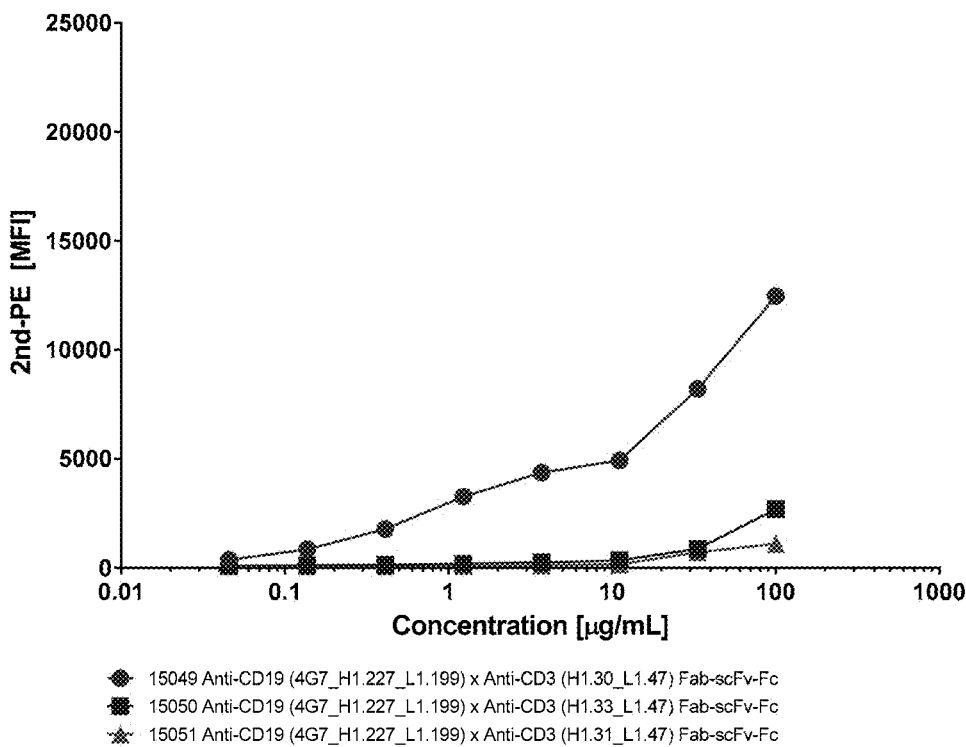

Figure 112
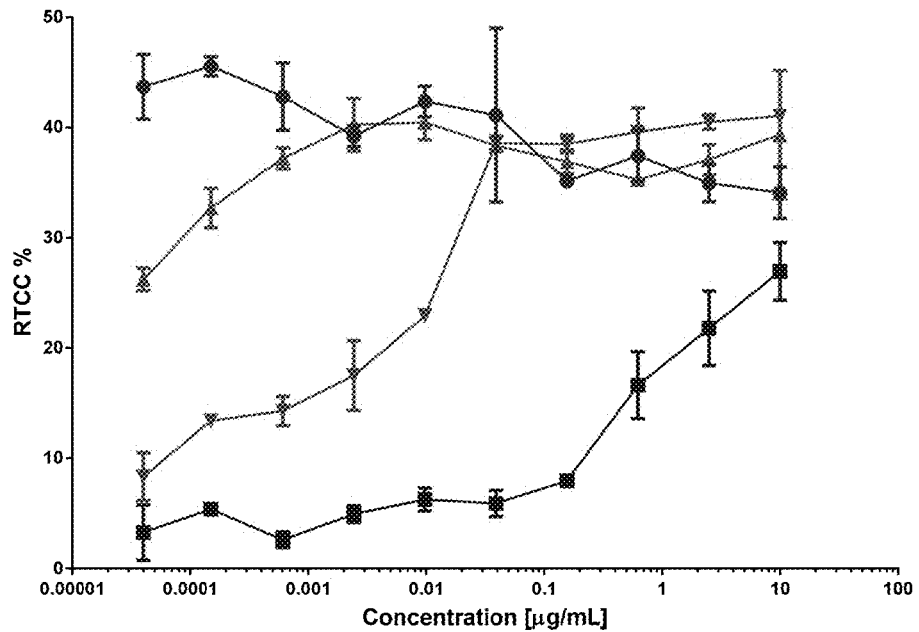
- 13677 Anti-CD20 (C2B8_H1.202_L1.113) x Anti-CD3 (H1.30_L1.47) Fab-scFv-Fc
- 14388 Anti-CD20 (C2B8_H1.202_L1.113) x Anti-CD3 (H1.31_L1.47) Fab-scFv-Fc
- 14389 Anti-CD20 (C2B8_H1.202_L1.113) x Anti-CD3 (H1.32_L1.47) Fab-scFv-Fc
- 14390 Anti-CD20 (C2B8_H1.202_L1.113) x Anti-CD3 (H1.33_L1.47) Fab-scFv-Fc
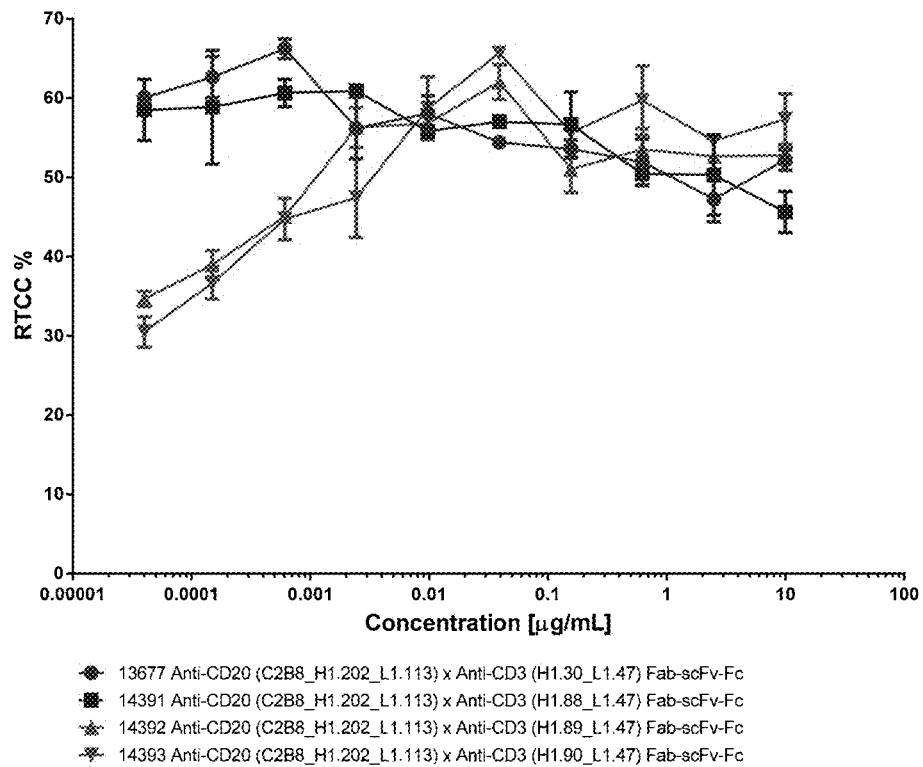
- 13677 Anti-CD20 (C2B8_H1.202_L1.113) x Anti-CD3 (H1.30_L1.47) Fab-scFv-Fc
- 14391 Anti-CD20 (C2B8_H1.202_L1.113) x Anti-CD3 (H1.88_L1.47) Fab-scFv-Fc
- 14392 Anti-CD20 (C2B8_H1.202_L1.113) x Anti-CD3 (H1.89_L1.47) Fab-scFv-Fc
- 14393 Anti-CD20 (C2B8_H1.202_L1.113) x Anti-CD3 (H1.90_L1.47) Fab-scFv-Fc Figure 115A
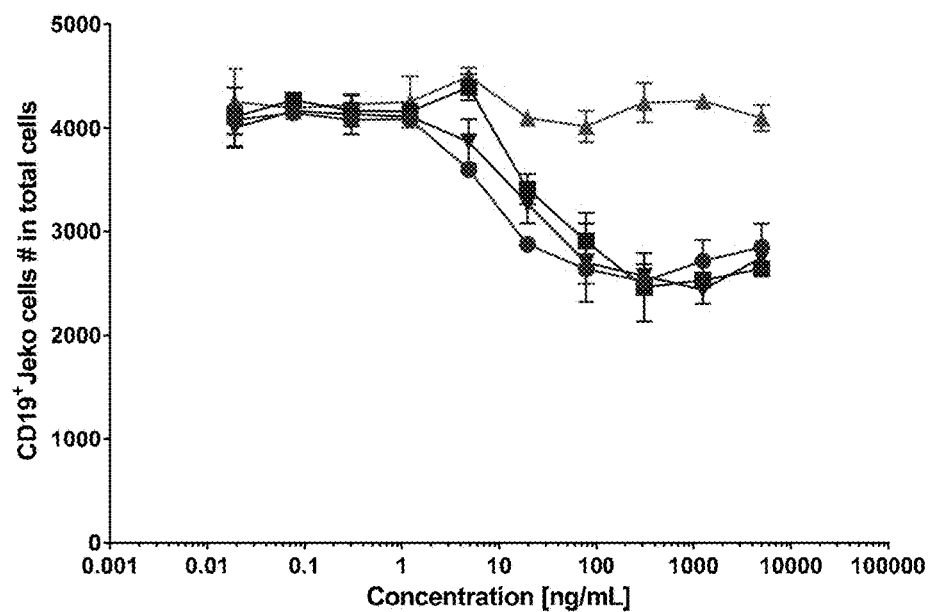
- 15629 Anti-CD20 (C2B8_H1L1) x Anti-CD3 (H1.32_L1.47) Fab-scFv-Fc
- 15630 Anti-CD20 (C2B8_H1L1) x Anti-CD3 (H1.88_L1.47) Fab-scFv-Fc
- 15631 Anti-CD20 (C2B8_H1L1) x Anti-CD3 (H1.89_L1.47) Fab-scFv-Fc
- 15632 Anti-CD20 (C2B8_H1L1) x Anti-CD3 (H1.90_L1.47) Fab-scFv-Fc
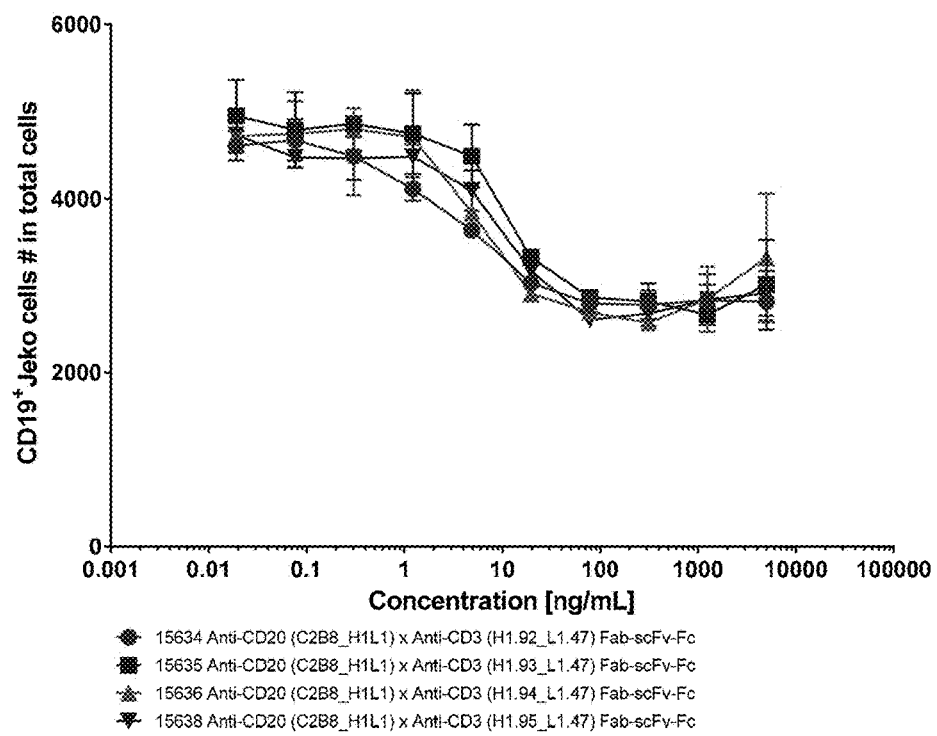
- 15634 Anti-CD20 (C2B8_H1L1) x Anti-CD3 (H1.92_L1.47) Fab-scFv-Fc
- 15635 Anti-CD20 (C2B8_H1L1) x Anti-CD3 (H1.93_L1.47) Fab-scFv-Fc
- 15636 Anti-CD20 (C2B8_H1L1) x Anti-CD3 (H1.94_L1.47) Fab-scFv-Fc
- 15638 Anti-CD20 (C2B8_H1L1) x Anti-CD3 (H1.95_L1.47) Fab-scFv-Fc Figure 116A
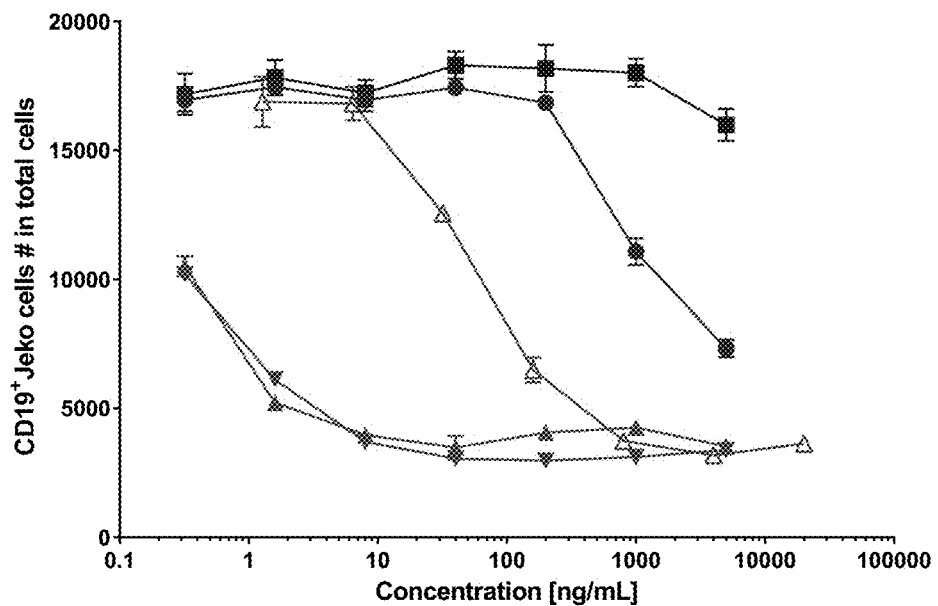
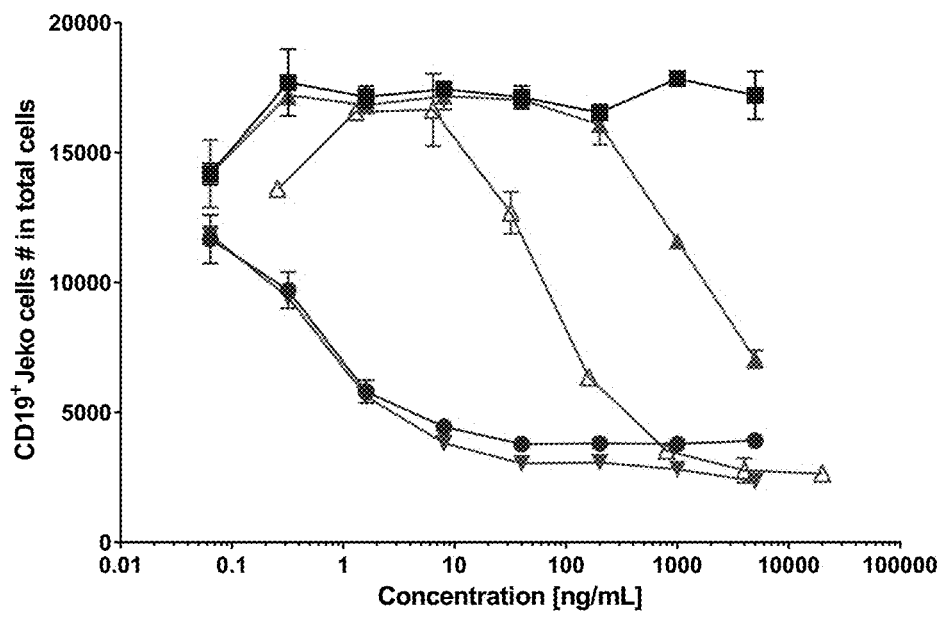

Figure 116B
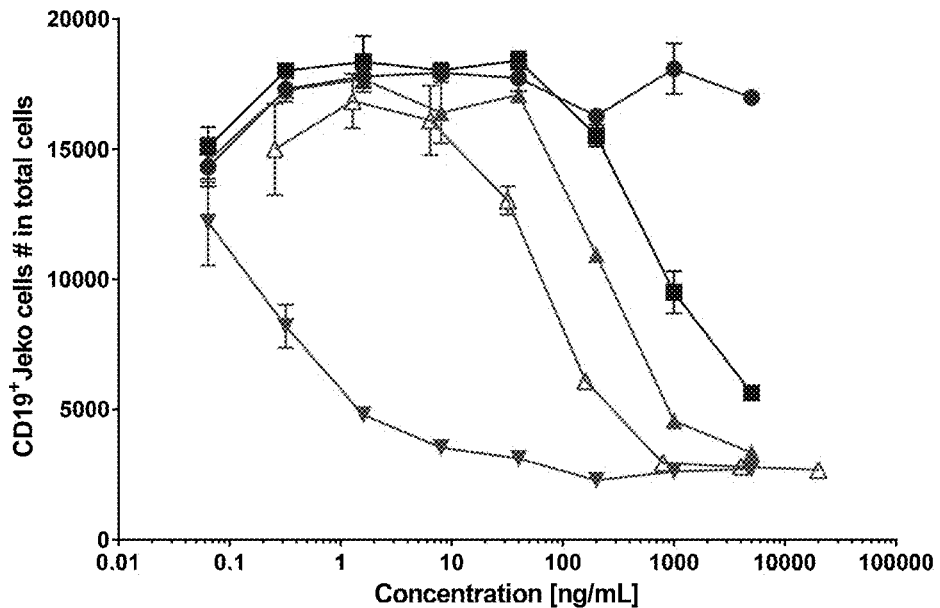
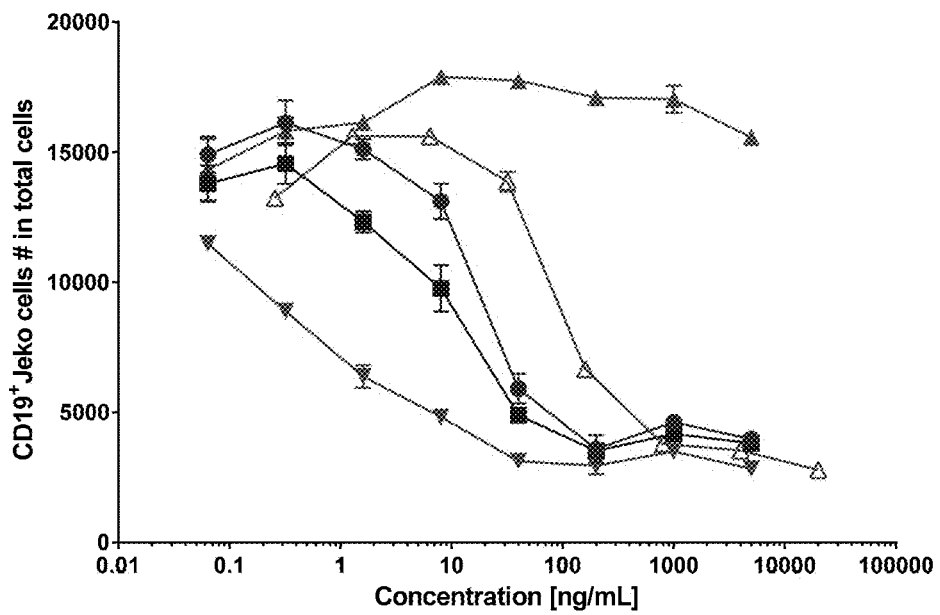

Figure 117
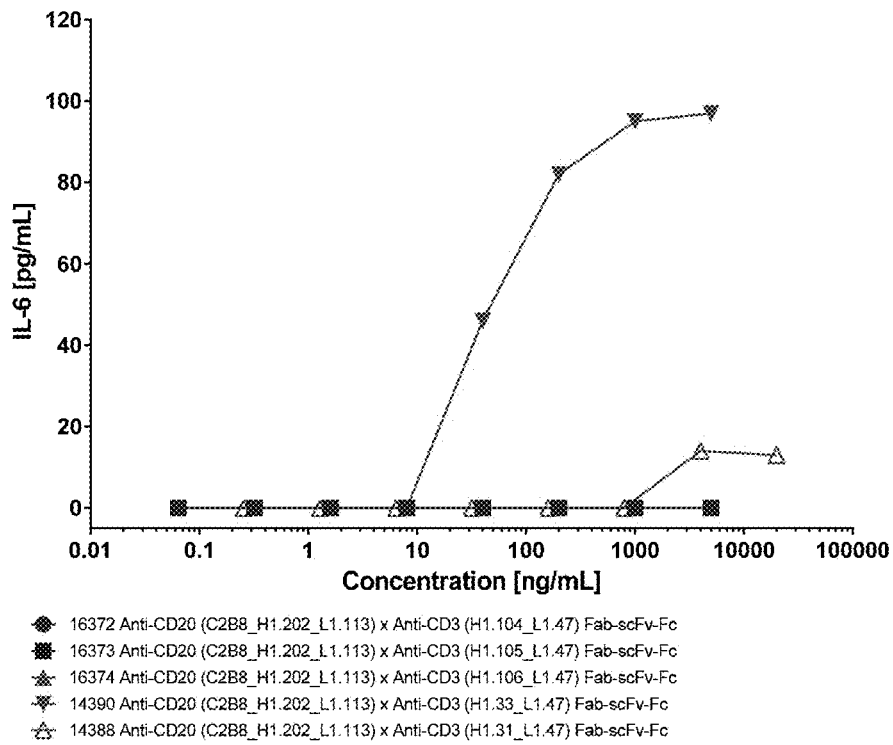
- 16372 Anti-CD20 (C2B8_H1.202_L1.113) x Anti-CD3 (H1.104_L1.47) Fab-scFv-Fc
- 16373 Anti-CD20 (C2B8_H1.202_L1.113) x Anti-CD3 (H1.105_L1.47) Fab-scFv-Fc
- 16374 Anti-CD20 (C2B8_H1.202_L1.113) x Anti-CD3 (H1.106_L1.47) Fab-scFv-Fc
- 14390 Anti-CD20 (C2B8_H1.202_L1.113) x Anti-CD3 (H1.33_L1.47) Fab-scFv-Fc
- 14388 Anti-CD20 (C2B8_H1.202_L1.113) x Anti-CD3 (H1.31_L1.47) Fab-scFv-Fc
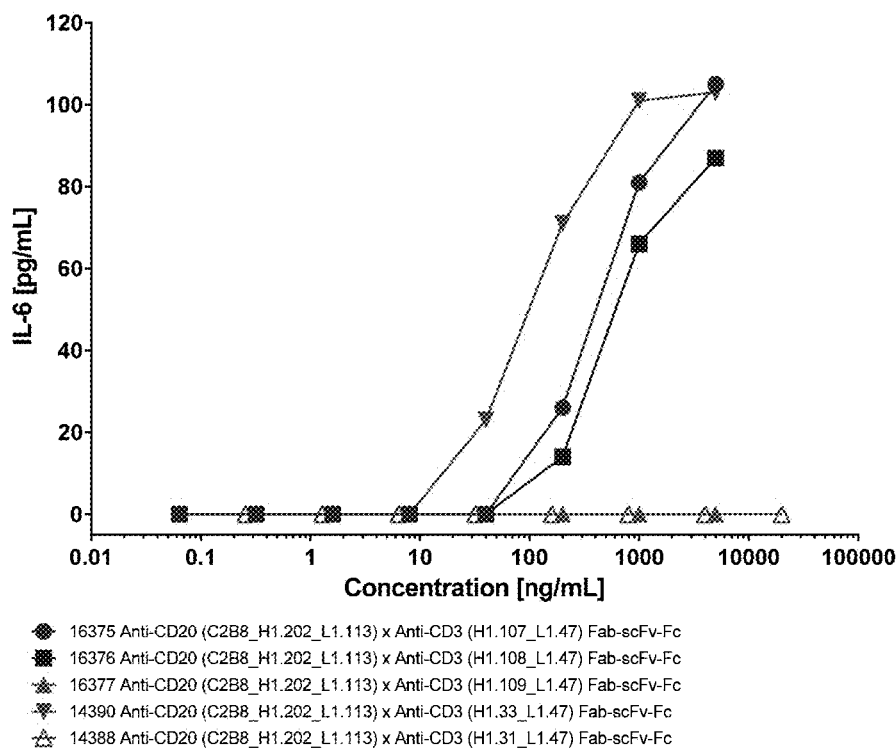
- 16375 Anti-CD20 (C2B8_H1.202_L1.113) x Anti-CD3 (H1.107_L1.47) Fab-scFv-Fc
- 16376 Anti-CD20 (C2B8_H1.202_L1.113) x Anti-CD3 (H1.108_L1.47) Fab-scFv-Fc
- 16377 Anti-CD20 (C2B8_H1.202_L1.113) x Anti-CD3 (H1.109_L1.47) Fab-scFv-Fc
- 14390 Anti-CD20 (C2B8_H1.202_L1.113) x Anti-CD3 (H1.33_L1.47) Fab-scFv-Fc
- 14388 Anti-CD20 (C2B8_H1.202_L1.113) x Anti-CD3 (H1.31_L1.47) Fab-scFv-Fc Figure 118
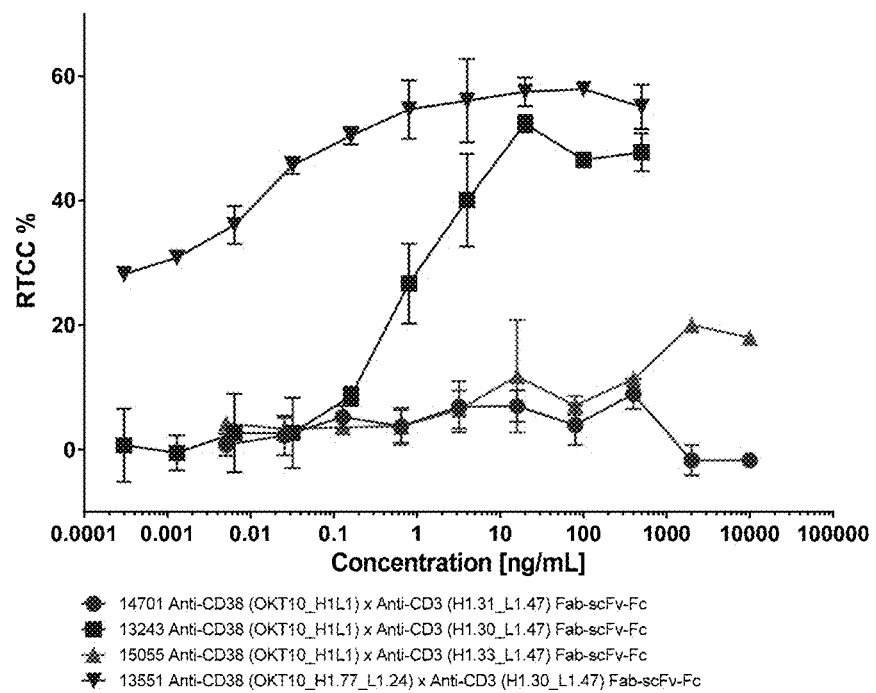
- 14701 Anti-CD38 (OKT10_H1L1) x Anti-CD3 (H1.31_L1.47) Fab-scFv-Fc
- 13243 Anti-CD38 (OKT10_H1L1) x Anti-CD3 (H1.30_L1.47) Fab-scFv-Fc
- 15055 Anti-CD38 (OKT10_H1L1) x Anti-CD3 (H1.33_L1.47) Fab-scFv-Fc
- 13551 Anti-CD38 (OKT10_H1.77_L1.24) x Anti-CD3 (H1.30_L1.47) Fab-scFv-Fc
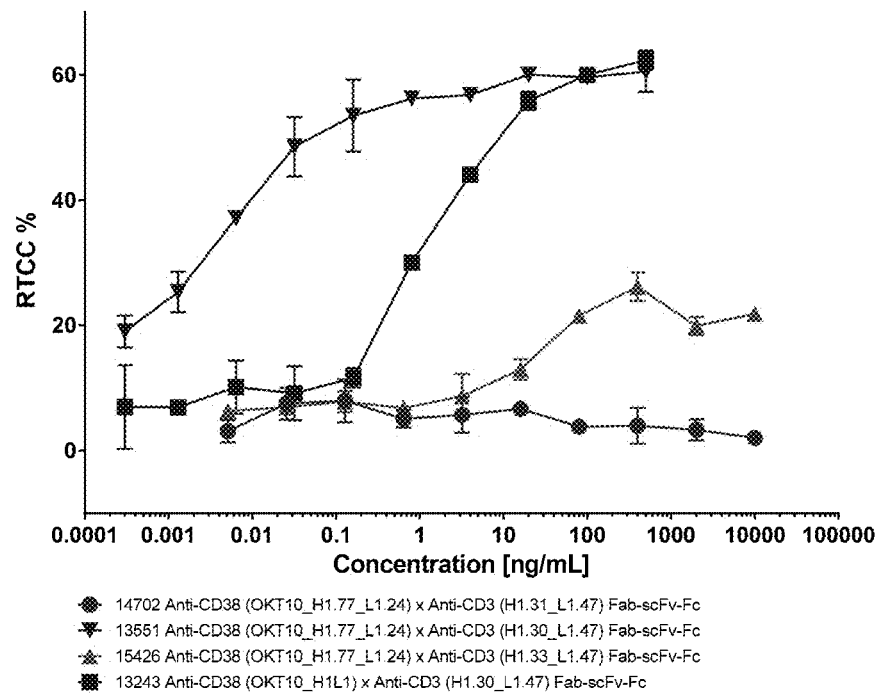
- 14702 Anti-CD38 (OKT10_H1.77_L1.24) x Anti-CD3 (H1.31_L1.47) Fab-scFv-Fc
- 13551 Anti-CD38 (OKT10_H1.77_L1.24) x Anti-CD3 (H1.30_L1.47) Fab-scFv-Fc
- 15426 Anti-CD38 (OKT10_H1.77_L1.24) x Anti-CD3 (H1.33_L1.47) Fab-scFv-Fc
- 13243 Anti-CD38 (OKT10_H1L1) x Anti-CD3 (H1.30_L1.47) Fab-scFv-Fc

Figure 121

High CD20 C2B8_H1.202_L1.113

| What | sequence | SEQ ID NO: |
|---|---|---|
| Variable heavy (vh) domain | QVQLVQSGAEVKKPGASVKVSCKASGYTFTWVRQAPGQRLEWMGAIYPGNGATSYSQKFQGRVTITADTSASTAYMELSSL RSEDTAVYYCARSYYMGGDWYFDVWGAGTLVTVSS | 421 |
| vhCDR1 | SYNMH | 422 |
| vhCDR2 | AIYPGNGATSYSQKFQG | 423 |
| vhCDR3 | SYYMGGDWYFDV | 424 |
| Variable light (vl) domain | QIVLTQSPSSLSASVGDRVTITCRASWSVSYIHWFQQKPGKSPKPLIYATSNLASGVPVRFSGSGSGTDYTLTISSLQPEDFATYY CQQWTHNPPTFGGGTKVEIK | 425 |
| vlCDR1 | RASWSVSYIH | 426 |
| vlCDR2 | ATSNLAS | 427 |
| vlCDR3 | QQWTHNPPT | 428 |
| scFv (including charged linker) | QVQLVQSGAEVKKPGASVKVSCKASGYTFTWVRQAPGQRLEWMGAIYPGNGATSYSQKFQGRVTITADTSASTAYMELSSL RSEDTAVYYCARSYYMGGDWYFDVWGAGTLVTVSSGKPGSGKPGSGKPGSGKPGSQIVLTQSPSSLSASVGDRVTITCRASW SVSYIHWFQQKPGKSPKPLIYATSNLASGVPVRFSGSGSGTDYTLTISSLQPEDFATYYCQQWTHNPPTFGGGTKVEIK | 429 |

Figure 122

Low CD20 C2B8_H1L1

| What | sequence | SEQ ID NO: |
|---|---|---|
| Variable heavy (vh) domain | QVQLVQSGAEVKKPGASVKVSCKASGYTFTSYNMHWVRQAPGQGLEWMGAIYPGNGDTSYNQKFQGRVTITADKSISTAY MELSSLRSEDTAVYYCARSTYYGGDWYFNVWGAGTLVTVSS | 430 |
| vhCDR1 | SYNMH | 431 |
| vhCDR2 | AIYPGNGDTSYNQKFQG | 432 |
| vhCDR3 | STYYGGDWYFNV | 433 |
| Variable light (vl) domain | QIVLTQSPSSLSASVGDRVTITCRASSSVSYIHWFQQKPGKSPKPLIYATSNLASGVPVRFSGSGSGTDYTLTISSLQPEDFATYYC QQWTSNPPTFGGGTKVEIK | 434 |
| vlCDR1 | RASSSVSYIH | 435 |
| vlCDR2 | ATSNLAS | 436 |
| vlCDR3 | QQWTSNPPT | 437 |
| scFv (including charged linker) | QVQLVQSGAEVKKPGASVKVSCKASGYTFTSYNMHWVRQAPGQGLEWMGAIYPGNGDTSYNQKFQGRVTITADKSISTAY MELSSLRSEDTAVYYCARSTYYGGDWYFNVWGAGTLVTVSSGKPGSSGKPGSSGKPGSSQIVLTQSPSSLSASVGDRVTIT CRASSSVSYIHWFQQKPGKSPKPLIYATSNLASGVPVRFSGSGSGTDYTLTISSLQPEDFATYCQQWTSNPPTFGGGTKVEIK | 438 |

| What | sequence | SEQ ID NO: |
|---|---|---|
| Variable heavy (vh) domain | QVQLQQSGAEVKKPGASVKVSCKASGYTFTDYYMKWVKQSHGKSLEWMGDIIPSNGATFYNQKFKGKATLTVDRSTSTAY MELSSLRSEDTAVYYCARSHLLRASWFAYWGQGTLVTVSS | 439 |
| vhCDR1 | DYYMK | 440 |
| vhCDR2 | DIIPSNGATFYNQKFKG | 441 |
| vhCDR3 | SHLLRASWFAY | 442 |
| Variable light (vl) domain | DFVMTQSPDSLAVSLGERATINCKSSQSLLNTGNQKNYLTWYQQKPGQPPKLLIYWASTRESGVPDRFTGSGSGTDFTLTISSL QAEDVAVYYCQNDYSYPYTFGGGTKLEIK | 443 |
| vlCDR1 | KSSQSLLNTGNQKNYLT | 444 |
| vlCDR2 | WASTRES | 445 |
| vlCDR3 | QNDYSYPYT | 446 |
| scFv (including charged linker) | QVQLQQSGAEVKKPGASVKVSCKASGYTFTDYYMKWVKQSHGKSLEWMGDIIPSNGATFYNQKFKGKATLTVDRSTSTAY MELSSLRSEDTAVYYCARSHLLRASWFAYWGQGTLVTVSSGKPGSSGKPGSSGKPGSDFVMTQSPDSLAVSLGERATIN CKSSQSLLNTGNQKNYLTWYQQKPGQPPKLLIYWASTRESGVPDRFTGSGSGTDFTLTISSLQAEDVAVYYCQNDYSYPYTFG GGTKLEIK | 447 |

Figure 124

| | | High CD3 | High-Int #1 CD3 | High-Int #2 CD3 | High-Int #3 CD3 | Int. CD3 | Low CD3 |
|---|---|---|---|---|---|---|---|
| | | Anti-CD3 | Anti-CD3 | Anti-CD3 | Anti-CD3 | Anti-CD3 | Anti-CD3 |
| | | H1.30_L1.47 | H1.32_L1.47 | H1.89_L1.47 | H1.90_L1.47 | H1.33_L1.47 | H1.31_L1.47 |
| High CD38 | OKT10 H1.77_L1.24 | A, B, C, D, E. F | A, B, C, D, E. F | A, B, C, D, E. F | A, B, C, D, E. F | A, B, C, D, E. F | A, B, C, D, E. F |
| Int CD38 | OKT10 H1L1.24 | A, B, C, D, E. F | A, B, C, D, E. F | A, B, C, D, E. F | A, B, C, D, E. F | A, B, C, D, E. F | A, B, C, D, E. F |
| Low CD38 | OKT10 H1L1 | A, B, C, D, E. F | A, B, C, D, E. F | A, B, C, D, E. F | A, B, C, D, E. F | A, B, C, D, E. F | A, B, C, D, E. F |
| High CD20 | C2B8_H1.202_L1.113 | A, B, C, D, E. F | A, B, C, D, E. F | A, B, C, D, E. F | A, B, C, D, E. F | A, B, C, D, E. F | A, B, C, D, E. F |
| Low CD20 | C2B8_H1L1 | A, B, C, D, E. F | A, B, C, D, E. F | A, B, C, D, E. F | A, B, C, D, E. F | A, B, C, D, E. F | A, B, C, D, E. F |
| CD123 | 7G3_H1.109_L1.57 | A, B, C, D, E. F | A, B, C, D, E. F | A, B, C, D, E. F | A, B, C, D, E. F | A, B, C, D, E. F | A, B, C, D, E. F |

Figure 126

| XENP Number | Variant | Substitution (VH) | Substitution (VL) | Fold improvement in off-rate vs. H1L1 | Tm (°C) |
|---|---|---|---|---|---|
| 13760 | 7G3_H0L0_Fab_His | H0 | L0 | 7.21 | 68.0 |
| 13761 | 7G3_H1L1_Fab_His | H1 | L1 | ----- | 70.0 |
| 13253 | 7G3_H1.1_L1_Fab_His | D31S | L1 | 0.88 | 69.5 |
| 13254 | 7G3_H1.2_L1_Fab_His | D31N | L1 | 0.95 | 69.5 |
| 13255 | 7G3_H1.3_L1_Fab_His | D31E | L1 | 0.83 | 70.0 |
| 13256 | 7G3_H1.4_L1_Fab_His | D31H | L1 | 0.81 | 69.5 |
| 13257 | 7G3_H1.5_L1_Fab_His | D31R | L1 | 0.47 | 70.0 |
| 13278 | 7G3_H1.26_L1_Fab_His | S56N | L1 | 1.12 | 69.5 |
| 13279 | 7G3_H1.27_L1_Fab_His | S56G | L1 | 2.05 | 69.5 |
| 13281 | 7G3_H1.29_L1_Fab_His | S56E | L1 | 1.32 | 70.0 |
| 13283 | 7G3_H1.31_L1_Fab_His | S56H | L1 | 1.43 | 69.5 |
| 13288 | 7G3_H1.36_L1_Fab_His | N59G | L1 | 1.69 | 68.5 |
| 13291 | 7G3_H1.39_L1_Fab_His | N59R | L1 | 0.45 | 68.0 |
| 13292 | 7G3_H1.40_L1_Fab_His | N59Y | L1 | 0.64 | 68.5 |
| 13294 | 7G3_H1.42_L1_Fab_His | T101A | L1 | 3.30 | 71.5 |
| 13318 | 7G3_H1.62_L1_Fab_His | L109Y | L1 | 1.38 | 69.0 |
| 13331 | 7G3_H1.75_L1_Fab_His | A111Q | L1 | 1.00 | 70.0 |
| 13735 | 7G3_H1.86_L1_Fab_His | Q69K R71K V72A M74L | L1 | 4.61 | 68.5 |
| 13736 | 7G3_H1.87_L1_Fab_His | K12V | L1 | 0.94 | 68.5 |
| 13737 | 7G3_H1.88_L1_Fab_His | P43H | L1 | 0.96 | 70.0 |
| 13738 | 7G3_H1.89_L1_Fab_His | M50I | L1 | 1.29 | 70.0 |
| 13740 | 7G3_H1.91_L1_Fab_His | E86H | L1 | 1.04 | 70.0 |
| 13741 | 7G3_H1.92_L1_Fab_His | R91T | L1 | 1.89 | 70.0 |
| 13742 | 7G3_H1.93_L1_Fab_His | Q1E V5Q A9P V11L K12V | L1 | 1.04 | 72.5 |
| 13743 | 7G3_H1.94_L1_Fab_His | R40K A42S P43H Q45K | L1 | 0.65 | 72.0 |
| 13744 | 7G3_H1.95_L1_Fab_His | V5Q | L1 | 1.24 | 69.0 |
| 13344 | 7G3_H1_L1.3_Fab_His | H1 | N31S | 2.77 | 68.5 |
| 13347 | 7G3_H1_L1.6_Fab_His | H1 | N31Q | 2.15 | 67.0 |
| 13854 | 7G3_H1_L1.56_Fab_His | H1 | S32A | 0.68 | 70.0 |
| 13855 | 7G3_H1_L1.57_Fab_His | H1 | S32T | 0.84 | 70.5 |
| 13349 | 7G3_H1_L1.8_Fab_His | H1 | S32Q | N.D. | 70.5 |
| 13350 | 7G3_H1_L1.9_Fab_His | H1 | S32V | 0.98 | 70.5 |
| 13351 | 7G3_H1_L1.10_Fab_His | H1 | S32E | 0.98 | 70.8 |
| 13352 | 7G3_H1_L1.11_Fab_His | H1 | S32K | 1.00 | 70.5 |
| 13353 | 7G3_H1_L1.12_Fab_His | H1 | S32Y | 0.86 | 69.5 |

Figure 127

| XENP Number | Variant | Substitution (VH) | Substitution (VL) | $k_{on}$ (M$^{-1}$s$^{-1}$) | $k_{off}$ (s$^{-1}$) | $K_A$ (1/M) | $K_D$ (M) | Tm (°C) |
|---|---|---|---|---|---|---|---|---|
| 13760 | 7G3_H0L0_Fab_His | H0 | L0 | 6.74E+05 | 1.08E-04 | 6.25E+09 | 1.60E-10 | 68.0 |
| 13761 | 7G3_H1L1_Fab_His | H1 | L1 | 3.95E+05 | 8.20E-04 | 4.81E+08 | 2.08E-09 | 70.0 |
| 13961 | 7G3_H1.107_L1_Fab_His | H1 - V5Q R40K A42S P43H Q45K Q69K R71K V72A M74L T101A | L1 | 6.00E+05 | 8.84E-05 | 6.79E+09 | 1.47E-10 | 71.0 |
| 13963 | 7G3_H1.109_L1_Fab_His | H1 - V5Q R40K A42S P43H Q45K Q69K R71K V72A M74L T101A | L1 | 7.45E+05 | 5.53E-05 | 1.35E+10 | 7.42E-11 | 73.0 |
| 13965 | 7G3_H1.107_L1.57_Fab_His | H1 - V5Q Q69K R71K V72A M74L T101A | S32T | 6.12E+05 | 3.82E-05 | 1.60E+10 | 6.24E-11 | 71.5 |
| 13967 | 7G3_H1.109_L1.57_Fab_His | H1 - V5Q R40K A42S P43H Q45K Q69K R71K V72A M74L T101A | S32T | 6.55E+05 | 6.25E-05 | 1.05E+10 | 9.54E-11 | 73.5 |

Figure 130
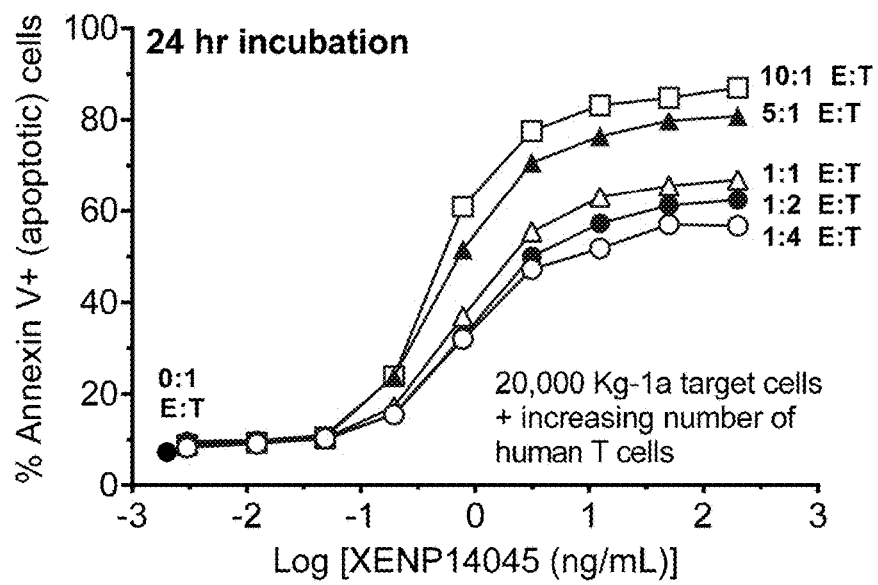
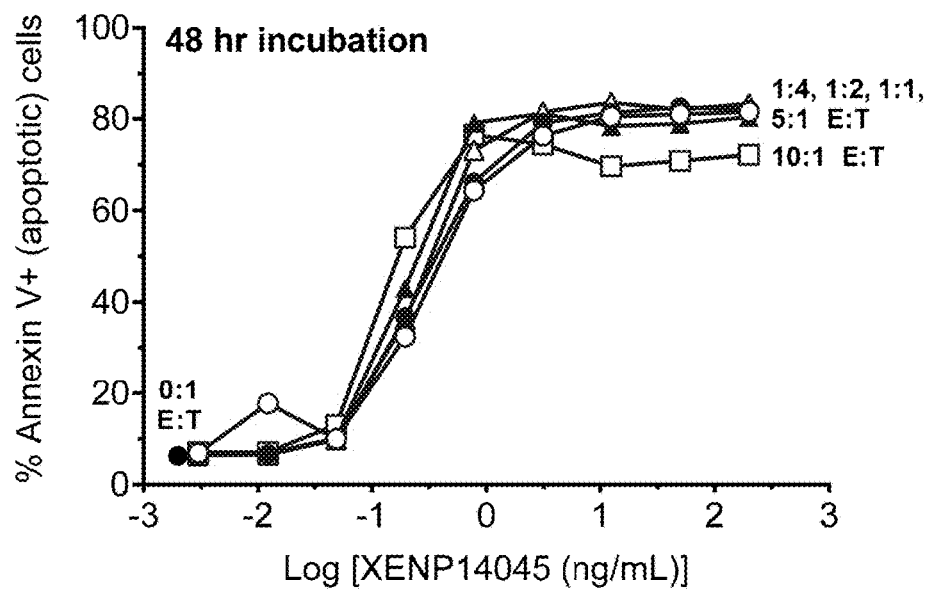

Figure 136 continued

XENP13760_7G3_H0L0_Fab_His Heavy chain
EVQLQQSGPELVKPGASVKMSCKASG<u>YTFTDYY</u>MKWVKQSHGKSLEWIGD<u>IIPSNGA</u>TFYNQKFKGKATLTVDRSSST
AYMHLNSLTSEDSAVYYCTR<u>SHLLRASWFAY</u>WGQGTLVTVSAASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCGSHHHHHH
(SEQ ID NO:453)

XENP13760_7G3_H0L0_Fab_His Light chain
DFVMTQSPSSLTVTAGEKVTMSCKSS<u>QSLLNSGNQKNY</u>LTWYLQKPGQPPKLLIY<u>WASTRES</u>GVPDRFTGSGSGTDFT
LTISSVQAEDLAVYYCQN<u>DYSYPYT</u>FGGGTKLEIKRTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC (SEQ ID NO:454)

XENP13761_7G3_H1L1_Fab_His Heavy chain
QVQLVQSGAEVKKPGASVKVSCKASG<u>YTFTDYY</u>MKWVRQAPGQSLEWMGD<u>IIPSNGA</u>TFYNQKFQGRVTMTVDRS
TSTAYMELSSLRSEDTAVYYCTR<u>SHLLRASWFAY</u>WGQGTLVTVSSASTKGPSVFPLAPSSKSTSGGTAALGCLVKDYFPE
PVTVSWNSGALTSGVHTFPAVLQSSGLYSLSSVVTVPSSSLGTQTYICNVNHKPSNTKVDKKVEPKSCGSHHHHHH
(SEQ ID NO:455)

XENP13761_7G3_H1L1_Fab_His Light chain
DFVMTQSPDSLAVSLGERATINCKSS<u>QSLLNSGNQKNY</u>LTWYQQKPGQPPKLLIY<u>WASTRES</u>GVPDRFTGSGSGTDFTL
TISSLQAEDVAVYYCQN<u>DYSYPYT</u>FGGGTKLEIKRTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:456)

XENP13961_7G3_H1.107_L1_Fab_His Heavy chain
QVQLQQSGAEVKKPGASVKVSCKASG<u>YTFTDYY</u>MKWVRQAPGQSLEWMGD<u>IIPSNGA</u>TFYNQKFKGKATLTVDRST
STAYMELSSLRSEDTAVYYCAR<u>SHLLRASWFAY</u>WGQGTLVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCGSHHHHHH
(SEQ ID NO:457)

XENP13961_7G3_H1.107_L1_Fab_His Light chain
DFVMTQSPDSLAVSLGERATINCKSS<u>QSLLNSGNQKNY</u>LTWYQQKPGQPPKLLIY<u>WASTRES</u>GVPDRFTGSGSGTDFTL
TISSLQAEDVAVYYCQN<u>DYSYPYT</u>FGGGTKLEIKRTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:458)

XENP13963_7G3_H1.109_L1_Fab_His Heavy chain
QVQLQQSGAEVKKPGASVKVSCKASG<u>YTFTDYY</u>MKWVKQSHGKSLEWMGD<u>IIPSNGA</u>TFYNQKFKGKATLTVDRSTS
TAYMELSSLRSEDTAVYYCAR<u>SHLLRASWFAY</u>WGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCGSHHHHHH
(SEQ ID NO:459)

XENP13963_7G3_H1.109_L1_Fab_His Light chain
DFVMTQSPDSLAVSLGERATINCKSS<u>QSLLNSGNQKNY</u>LTWYQQKPGQPPKLLIY<u>WASTRES</u>GVPDRFTGSGSGTDFTL
TISSLQAEDVAVYYCQN<u>DYSYPYT</u>FGGGTKLEIKRTVAAPSVFIFPPSDEQLKSGTASVVCLLNNFYPREAKVQWKVDNA
LQSGNSQESVTEQDSKDSTYSLSSTLTLSKADYEKHKVYACEVTHQGLSSPVTKSFNRGEC (SEQ ID NO:460)

Figure 136 continued

XENP13965 7G3_H1.107_L1.57_Fab_His Heavy chain
QVQLQQSGAEVKKPGASVKVSCKASGYTFTDYYMKWVRQAPGQSLEWMGDIIPSNGATFYNQKFKGKATLTVDRST
STAYMELSSLRSEDTAVYYCARSHLLRASWFAYWGQGTLVTVSSASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCGSHHHHHH
(SEQ ID NO:461)

XENP13965 7G3_H1.107_L1.57_Fab_His Light chain
DFVMTQSPDSLAVSLGERATINCKSSQSLLNTGNQKNYLTWYQQKPGQPPKLLIYWASTRESGVPDRFTGSGSGTDFT
LTISSLQAEDVAVYYCQNDYSYPYTFGGGTKLEIKRTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC (SEQ ID NO:462)

XENP13967 7G3_H1.109_L1.57_Fab_His Heavy chain
QVQLQQSGAEVKKPGASVKVSCKASGYTFTDYYMKWVKQSHGKSLEWMGDIIPSNGATFYNQKFKGKATLTVDRSTS
TAYMELSSLRSEDTAVYYCARSHLLRASWFAYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCGSHHHHHH
(SEQ ID NO:463)

XENP13967 7G3_H1.109_L1.57_Fab_His Light chain
DFVMTQSPDSLAVSLGERATINCKSSQSLLNTGNQKNYLTWYQQKPGQPPKLLIYWASTRESGVPDRFTGSGSGTDFT
LTISSLQAEDVAVYYCQNDYSYPYTFGGGTKLEIKRTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC (SEQ ID NO:464)

XENP13928 Anti-CD123 x Anti-CD3 Fab-scFv-Fc Heavy Chain 1 (Anti-CD123 Fab-Fc (7G3_H0))
EVQLQQSGPELVKPGASVKMSCKASGYTFTDYYMKWVKQSHGKSLEWIGDIIPSNGATFYNQKFKGKATLTVDRSSST
AYMHLNSLTSEDSAVYYCTRSHLLRASWFAYWGQGTLVTVSAASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK (SEQ ID NO:465)

XENP13928 Anti-CD123 x Anti-CD3 Fab-scFv-Fc Heavy Chain 2 (Anti-CD3 scFv-Fc (αCD3_H1.30_L1.47))
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK (SEQ ID NO:466)

XENP13928 Anti-CD123 x Anti-CD3 Fab-scFv-Fc Light Chain (Anti-CD123 LC (7G3_L0))
DFVMTQSPSSLTVTAGEKVTMSCKSSQSLLNSGNQKNYLTWYLQKPGQPPKLLIYWASTRESGVPDRFTGSGSGTDFT
LTISSVQAEDLAVYYCQNDYSYPYTFGGGTKLEIKRTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC (SEQ ID NO:467)

Figure 136 continued

XENP14045 Anti-CD123 x Anti-CD3 Fab-scFv-Fc Heavy Chain 1 (Anti-CD123 Fab-Fc (7G3_H1.109))
QVQLQQSGAEVKKPGASVKVSCKASGYTFTDYYMKWVKQSHGKSLEWMGDIIPSNGATFYNQKFKGKATLTVDRSTS
TAYMELSSLRSEDTAVYYCARSHLLRASWFAYWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSDTKVDKKVEPKSCDKTHTCPPCPAPPV
AGPSVFLFPPKPKDTLMISRTPEVTCVVVDVKHEDPEVKFNWYVDGVEVHNAKTKPREEEYNSTYRVVSVLTVLHQDW
LNGKEYKCKVSNKALPAPIEKTISKAKGQPREPQVYTLPPSREEMTKNQVSLTCDVSGFYPSDIAVEWESDGQPENNYK
TTPPVLDSDGSFFLYSKLTVDKSRWEQGDVFSCSVMHEALHNHYTQKSLSLSPGK (SEQ ID NO:468)

XENP14045 Anti-CD123 x Anti-CD3 Fab-scFv-Fc Heavy Chain 2 (Anti-CD3 scFv-Fc (αCD3_H1.30_L1.47))
EVQLVESGGGLVQPGGSLRLSCAASGFTFSTYAMNWVRQAPGKGLEWVGRIRSKYNNYATYYADSVKGRFTISRDDSK
NTLYLQMNSLRAEDTAVYYCVRHGNFGDSYVSWFAYWGQGTLVTVSSGKPGSGKPGSGKPGSGKPGSQAVVTQEPS
LTVSPGGTVTLTCGSSTGAVTTSNYANWVQQKPGKSPRGLIGGTNKRAPGVPARFSGSLLGGKAALTISGAQPEDEAD
YYCALWYSNHWVFGGGTKLTVLEPKSSDKTHTCPPCPAPPVAGPSVFLFPPKPKDTLMISRTPEVTCVVVDVKHEDPEV
KFNWYVDGVEVHNAKTKPREEQYNSTYRVVSVLTVLHQDWLNGKEYKCKVSNKALPAPIEKTISKAKGQPREPQVYTL
PPSREQMTKNQVKLTCLVKGFYPSDIAVEWESNGQPENNYKTTPPVLDSDGSFFLYSKLTVDKSRWQQGNVFSCSVM
HEALHNHYTQKSLSLSPGK (SEQ ID NO:469)

XENP14045 Anti-CD123 x Anti-CD3 Fab-scFv-Fc Light Chain (Anti-CD123 LC (7G3_L1.57))
DFVMTQSPDSLAVSLGERATINCKSSQSLLNTGNQKNYLTWYQQKPGQPPKLLIYWASTRESGVPDRFTGSGSGTDFT
LTISSLQAEDVAVYYCQNDYSYPYTFGGGTKLEIKRTVAAPSVFIFPPSDEQLKSGTASVVCLLNNFYPREAKVQWKVDN
ALQSGNSQESVTEQDSKDSTYSLSSTLTLSKADYEKHKVYACEVTHQGLSSPVTKSFNRGEC (SEQ ID NO:470)

Figure 137

| Pool | DNA (%) | | | Heterodimer (%) |
|---|---|---|---|---|
| | Light chain | HC1 (Fab-Fc) | HC2 (scFv-Fc) | |
| A | 50.0 | 25.0 | 25.0 | 23.3 |
| B | 44.4 | 22.2 | 33.3 | 84.9 |
| C | 40.0 | 20.0 | 40.0 | 72.2 |
| D | 36.4 | 18.2 | 45.5 | 66.6 |
| E | 37.5 | 25.0 | 37.5 | 54.1 |
| F | 42.9 | 28.6 | 28.6 | 83.8 |

| Condition | Heterodimer (%) |
|---|---|
| F2-01 | 96.9 |
| F2-02 | 93.7 |
| F2-04 | 92.8 |
| F2-05 | 86.0 |
| F2-07 | 100.0 |
| F2-11 | 95.4 |
| F2-13 | 94.8 |
| F2-14 | 85.8 |
| F2-15 | 85.8 |
| F2-16 | 100.0 |
| F2-21 | 82.0 |
| F2-27 | 47.6 |

Basophil gate, flow cytometry: CD20- CD16- CD14- CD4- CD8- FceRI+

HETERODIMERIC ANTIBODIES TO CD3 X CD20

CROSS-REFERENCE TO RELATED APPLICATIONS

This application is a continuation of U.S. patent application Ser. No. 14/952,714, filed Nov. 25, 2015, which claims priority under 35 U.S.C. §119(e) to U.S. Provisional Patent Application No. 62/085,117, filed Nov. 26, 2014, U.S. Provisional Patent Application No. 62/084,908, filed Nov. 26, 2014, U.S. Provisional Patent Application No. 62/085,027, filed Nov. 26, 2014, U.S. Provisional Patent Application No. 62/159,111, filed May 8, 2015 and U.S. Provisional Patent Application No. 62/251,005, filed Nov. 4, 2015, all of which are expressly incorporated herein by reference in their entirety, with particular reference to the figures, legends and claims therein.

BACKGROUND OF THE INVENTION

Antibody-based therapeutics have been used successfully to treat a variety of diseases, including cancer and autoimmune/inflammatory disorders. Yet improvements to this class of drugs are still needed, particularly with respect to enhancing their clinical efficacy. One avenue being explored is the engineering of additional and novel antigen binding sites into antibody-based drugs such that a single immunoglobulin molecule co-engages two different antigens. Such non-native or alternate antibody formats that engage two different antigens are often referred to as bispecifics. Because the considerable diversity of the antibody variable region (Fv) makes it possible to produce an Fv that recognizes virtually any molecule, the typical approach to bispecific generation is the introduction of new variable regions into the antibody.

A number of alternate antibody formats have been explored for bispecific targeting (Chames & Baty, 2009, mAbs 1[6]:1-9; Holliger & Hudson, 2005, Nature Biotechnology 23[9]:1126-1136; Kontermann, mAbs 4(2):182 (2012), all of which are expressly incorporated herein by reference). Initially, bispecific antibodies were made by fusing two cell lines that each produced a single monoclonal antibody (Milstein et al., 1983, Nature 305:537-540). Although the resulting hybrid hybridoma or quadroma did produce bispecific antibodies, they were only a minor population, and extensive purification was required to isolate the desired antibody. An engineering solution to this was the use of antibody fragments to make bispecifics. Because such fragments lack the complex quaternary structure of a full length antibody, variable light and heavy chains can be linked in single genetic constructs. Antibody fragments of many different forms have been generated, including diabodies, single chain diabodies, tandem scFv's, and $Fab_2$ bispecifics (Chames & Baty, 2009, mAbs 1[6]:1-9; Holliger & Hudson, 2005, Nature Biotechnology 23[9]:1126-1136; expressly incorporated herein by reference). While these formats can be expressed at high levels in bacteria and may have favorable penetration benefits due to their small size, they clear rapidly in vivo and can present manufacturing obstacles related to their production and stability. A principal cause of these drawbacks is that antibody fragments typically lack the constant region of the antibody with its associated functional properties, including larger size, high stability, and binding to various Fc receptors and ligands that maintain long half-life in serum (i.e. the neonatal Fc receptor FcRn) or serve as binding sites for purification (i.e. protein A and protein G).

More recent work has attempted to address the shortcomings of fragment-based bispecifics by engineering dual binding into full length antibody-like formats (Wu et al., 2007, Nature Biotechnology 25[11]:1290-1297; U.S. Ser. No. 12/477,711; Michaelson et al., 2009, mAbs 1[2]:128-141; PCT/US2008/074693; Zuo et al., 2000, Protein Engineering 13[5]:361-367; U.S. Ser. No. 09/865,198; Shen et al., 2006, J Biol Chem 281[16]:10706-10714; Lu et al., 2005, J Biol Chem 280[20]:19665-19672; PCT/US2005/025472; expressly incorporated herein by reference). These formats overcome some of the obstacles of the antibody fragment bispecifics, principally because they contain an Fc region. One significant drawback of these formats is that, because they build new antigen binding sites on top of the homodimeric constant chains, binding to the new antigen is always bivalent.

For many antigens that are attractive as co-targets in a therapeutic bispecific format, the desired binding is monovalent rather than bivalent. For many immune receptors, cellular activation is accomplished by cross-linking of a monovalent binding interaction. The mechanism of cross-linking is typically mediated by antibody/antigen immune complexes, or via effector cell to target cell engagement. For example, the low affinity Fc gamma receptors (FcγRs) such as FcγRIIa, FcγRIIb, and FcγRIIIa bind monovalently to the antibody Fc region. Monovalent binding does not activate cells expressing these FcγRs; however, upon immune complexation or cell-to-cell contact, receptors are cross-linked and clustered on the cell surface, leading to activation. For receptors responsible for mediating cellular killing, for example FcγRIIIa on natural killer (NK) cells, receptor cross-linking and cellular activation occurs when the effector cell engages the target cell in a highly avid format (Bowles & Weiner, 2005, J Immunol Methods 304:88-99, expressly incorporated by reference). Similarly, on B cells the inhibitory receptor FcγRIIb downregulates B cell activation only when it engages into an immune complex with the cell surface B-cell receptor (BCR), a mechanism that is mediated by immune complexation of soluble IgG's with the same antigen that is recognized by the BCR (Heyman 2003, Immunol Lett 88[2]:157-161; Smith and Clatworthy, 2010, Nature Reviews Immunology 10:328-343; expressly incorporated by reference). As another example, CD3 activation of T-cells occurs only when its associated T-cell receptor (TCR) engages antigen-loaded MHC on antigen presenting cells in a highly avid cell-to-cell synapse (Kuhns et al., 2006, Immunity 24:133-139). Indeed nonspecific bivalent cross-linking of CD3 using an anti-CD3 antibody elicits a cytokine storm and toxicity (Penuche et al., 2009, J Immunol 183[2]: 953-61; Chatenoud & Bluestone, 2007, Nature Reviews Immunology 7:622-632; expressly incorporated by reference). Thus for practical clinical use, the preferred mode of CD3 co-engagement for redirected killing of targets cells is monovalent binding that results in activation only upon engagement with the co-engaged target.

CD38, also known as cyclic ADP ribose hydrolase, is a type II transmembrane glycoprotein with a long C-terminal extracellular domain and a short N-terminal cytoplasmic domain. Among hematopoietic cells, an assortment of functional effects have been ascribed to CD38 mediated signaling, including lymphocyte proliferation, cytokine release, regulation of B and myeloid cell development and survival, and induction of dendritic cell maturation. CD38 is unregulated in many hematopoeitic malignancies and in cell lines derived from various hematopoietic malignancies including non-Hodgkin's lymphoma (NHL), Burkitt's lymphoma (BL), multiple myeloma (MM), B chronic lymphocytic leukemia (B-CLL), B and T acute lymphocytic leukemia (ALL), T cell lymphoma (TCL), acute myeloid leukemia (AML), hairy cell leukemia (HCL), Hodgkin's Lymphoma (HL), and chronic myeloid leukemia (CML). On the other hand, most primitive pluripotent stem cells of the hematopoietic system are CD38–. In spite of the recent progress in the discovery and development of anti-cancer agents, many forms of cancer involving CD38-expressing tumors still have a poor prognosis. Thus, there is a need for improved methods for treating such forms of cancer.

B-cell antigen CD19 (CD19, also known as B-cell surface antigen B4, Leu-12) is a human pan-B-cell surface marker that is expressed from early stages of pre-B cell development through terminal differentiation into plasma cells. CD 19 promotes the proliferation and survival of mature B cells. It associates in a complex with CD21 on the cell surface. It also associates with CD81 and Leu-13 and potentiates B cell receptor (BCR) signaling. Together with the BCR, CD19 modulates intrinsic and antigen receptor-induced signaling thresholds critical for clonal expansion of B cells and humoral immunity. In collaboration with CD21 it links the adaptive and the innate immune system. Upon activation, the cytoplasmic tail of CD19 becomes phosphorylated which leads to binding by Src-family kinases and recruitment of PI-3 kinase. It is an attractive immunotherapy target for cancers of lymphoid origin since it is also expressed on the vast majority of NHL cells as well as some leukemias.

A number of antibodies or antibody conjugates that target CD19 have been evaluated in pre-clinical studies or in clinical trials for the treatment of cancers. These anti-CD19 antibodies or antibody conjugates include but are not limited to MT-103 (a single-chain bispecific CD19/CD3 antibody; Hoffman et al, 2005 Int J Cancer 115:98-104; Schlereth et al, 2006 Cancer Immunol Immunother 55:503-514), a CD19/CD16 diabody (Schlenzka et al, 2004 Anti-cancer Drugs 15:915-919; Kipriyanov et al, 2002 J Immunol 169:137-144), BU12-saporin (Flavell et al, 1995 Br J Cancer 72:1373-1379), and anti-CD19-idarubicin (Rowland et al, 1993 Cancer Immunol Immunother 55:503-514); all expressly incorporated by reference.

CD123, also known as interleukin-3 receptor alpha (IL-3Rα), is expressed on dendritic cells, monocytes, eosinophils and basophils. CD123 is also constitutively expressed by committed hematopoietic stem/progenitor cells, by most of the myeloid lineage (CD13+, CD14+, CD33+, CD15low), and by some CD19+ cells. It is absent from CD3+ cells.

Thus while bispecifics generated from antibody fragments suffer biophysical and pharmacokinetic hurdles, a drawback of those built with full length antibody-like formats is that they engage co-target antigens multivalently in the absence of the primary target antigen, leading to nonspecific activation and potentially toxicity. The present invention solves this problem by introducing novel bispecific antibodies directed to CD3 and CD38.

BRIEF SUMMARY OF THE INVENTION

Accordingly, in one aspect the present invention provides heterodimeric antibodies comprising: a) a first monomer comprising: i) a first heavy chain comprising: 1) a first variable heavy domain; 2) a first constant heavy chain comprising a first Fc domain; 3) a scFv comprising a scFv variable light domain, an scFv linker and a scFv variable heavy domain; wherein said scFv is covalently attached to the C-terminus of said Fc domain using a domain linker; b) a second monomer comprising a second heavy chain comprising a second variable heavy domain and a second constant heavy chain comprising a second Fc domain; and c) a common light chain comprising a variable light domain and a constant light domain.

In a further aspect, the invention provides heterodimeric antibodies comprising: a) a first monomer comprising: i) a first heavy chain comprising: 1) a first variable heavy domain; 2) a first constant heavy domain comprising a first Fc domain; and 3) a first variable light domain, wherein said first variable light domain is covalently attached to the C-terminus of said first Fc domain using a domain linker; b) a second monomer comprising: i) a second variable heavy domain; ii) a second constant heavy domain comprising a second Fc domain; and iii) a third variable heavy domain, wherein said second variable heavy domain is covalently attached to the C-terminus of said second Fc domain using a domain linker; c) a common light chain comprising a variable light domain and a constant light domain.

In an additional aspect, the invention provides heterodimeric antibodies comprising: a) a first monomer comprising: i) a first heavy chain comprising: 1) a first variable heavy domain; 2) a first constant heavy chain comprising a first CH1 domain and a first Fc domain; 3) a scFv comprising a scFv variable light domain, an scFv linker and a scFv variable heavy domain; wherein said scFv is covalently attached between the C-terminus of said CH1 domain and the N-terminus of said first Fc domain using domain linkers; b) a second monomer comprising a second heavy chain comprising a second variable heavy domain and a second constant heavy chain comprising a second Fc domain; and c) a common light chain comprising a variable light domain and a constant light domain.

In a further aspect, the invention provides heterodimeric antibodies comprising: a) a first monomer comprising: i) a first heavy chain comprising: 1) a first variable heavy domain; 2) a first constant heavy domain comprising a first Fc domain; and 3) a first variable light domain, wherein said second variable light domain is covalently attached between the C-terminus of the CH1 domain of said first constant heavy domain and the N-terminus of said first Fc domain using domain linkers; b) a second monomer comprising: i) a second variable heavy domain; ii) a second constant heavy domain comprising a second Fc domain; and iii) a third variable heavy domain, wherein said second variable heavy domain is covalently attached to the C-terminus of said second Fc domain using a domain linker; c) a common light chain comprising a variable light domain and a constant light domain.

In an additional aspect, the invention provides heterodimeric antibodies comprising: a) a first monomer comprising: i) a first heavy chain comprising: 1) a first variable heavy domain; 2) a first constant heavy chain comprising a first CH1 domain and a first Fc domain; 3) a scFv comprising a scFv variable light domain, an scFv linker and a scFv variable heavy domain; wherein said scFv is covalently attached between the C-terminus of said CH1 domain and the N-terminus of said first Fc domain using domain linkers; b) a second monomer comprising a second Fc domain; and c) a light chain comprising a variable light domain and a constant light domain.

In some aspects, the first and second Fc domains have a set of amino acid substitutions selected from the group consisting of S364K/E357Q:L368D/K370S; L368D/K370S: S364K; L368E/K370S:S364K; T411T/E360E/Q362E: D401K; L368D/K370S:S364K/E357L and K370S:S364K/

E357Q. Furthermore, the variable heavy domain(s) and the variable light domain(s) bind a first target tumor antigen (TTA), the scFv binds a second TTA or human CD3. In some embodiments, the TTA is selected from the group consisting of CD19, CD20 and CD123.

In a further aspect, the invention provides anti-CD3 antigen binding domains have CDRs and/or the variable domains and/or the scFv sequences depicted in the Figures for H1.32_L1.47, H1.89_L1.47, H1.90_L1.47, H1.33_L.1.47 and H1.31_L1.47. The invention further provides nucleic acid compositions, expression vector compositions and host cells.

In an additional aspect, the invention provides heterodimeric antibodies comprising a) a first monomer comprising: i) a first Fc domain; ii) an anti-CD3 scFv comprising a scFv variable light domain, an scFv linker and a scFv variable heavy domain; wherein said scFv is covalently attached to the N-terminus of said Fc domain using a domain linker; b) a second monomer comprising a heavy chain comprising: i) a heavy variable domain; and ii) a heavy chain constant domain comprising a second Fc domain; and c) a light chain comprising a variable light domain and a variable light constant domain; wherein the anti-CD3 scFv is selected from the group consisting of anti-CD3 H1.32_L1.47, anti-CD3 H1.89_L1.47, anti-CD3 H1.90_L1.47 and anti-CD3 H1.33_L1.47. The heavy variable domain and the light variable domain bind a TTA (including, but not limited to CD19, Cd20, CD38 and CD123).

In an additional aspect, the invention provides anti-CD20 antibody binding domains comprising: a) a variable light domain comprising a vlCDR1 having the sequence RASWSVSYIH (SEQ ID NO:426), a vlCDR2 having the sequence ATSNLAS (SEQ ID NOS:427 and 436), and a vlCDR3 having the sequence QQWTHNPPT (SEQ ID NO:428); and b) a variable heavy domain comprises a vhCDR1 having the sequence SYNMH (SEQ ID NOS:422 and 431), a vhCDR2 having the sequence AIYPGNGATSYSQKFQG (SEQ ID NO:423) and a vhCDR3 having the sequence SYYMGGDWYFDV (SEQ ID NO:424). In some embodiments, the anti-CD20 antibody binding domains have the C2B8 H1.202_L1.113 sequences.

In an additional aspect, the invention provides anti-CD20 antibody binding domains comprising: a) a variable light domain comprising a vlCDR1 having the sequence RASSSVSYIH (SEQ ID NO:435), a vlCDR2 having the sequence ATSNLAS (SEQ ID NOS:427 and 436), and a vlCDR3 having the sequence QQWTSNPPT (SEQ ID NO:437); and b) a variable heavy domain comprises a vhCDR1 having the sequence SYNMH (SEQ ID NOS:422 and 431), a vhCDR2 having the sequence AIYPGNGDTSYNQKFQG (SEQ ID NO:432) and a vhCDR3 having the sequence STYYGGDWYFNV (SEQ ID NO:433).

In some embodiments, the anti-CD20 antibody binding domains have the C2B8_H1L1 sequences.

In an additional aspect, the invention provides heterodimeric antibodies comprising a) a first monomer comprising: i) a first Fc domain; ii) an anti-CD3 scFv comprising a scFv variable light domain, an scFv linker and a scFv variable heavy domain; wherein said scFv is covalently attached to the N-terminus of said Fc domain using a domain linker; b) a second monomer comprising a heavy chain comprising: i) a heavy variable domain; and ii) a heavy chain constant domain comprising a second Fc domain; and c) a light chain comprising a variable light domain and a variable light constant domain; wherein the variable heavy and light chains form a C2B8 H1.202_L1.113 or C2B8_H1L1 binding domain.

In an additional aspect, the invention provides heterodimeric antibodies comprising a) a first monomer comprising: i) a first Fc domain; ii) an anti-CD3 scFv comprising a scFv variable light domain, an scFv linker and a scFv variable heavy domain; wherein said scFv is covalently attached to the N-terminus of said Fc domain using a domain linker; b) a second monomer comprising a heavy chain comprising: i) a heavy variable domain; and ii) a heavy chain constant domain comprising a second Fc domain; and c) a light chain comprising a variable light domain and a variable light constant domain. In this embodiment, the variable domains bind CD123 and can have the sequences of 7G3_H1.109_L1.47.

In additional aspects, the present invention provides heterodimeric antibodies selected from the group consisting of XENP15049, XENP15051; XENP15050, XENP13676, XENP14696, XENP15629, XENP15053, XENP15630, XENP15631, XENP15632, XENP15633, XENP15634, XENP15635, XENP15636, XENP15638, XENP15639, XENP13677, XENP14388, XENP14389, XENP14390, XENP14391, XENP14392, XENP14393, XENP16366, XENP16367, XENP16368, XENP16369, XENP16370, XENP16371, XENP16372, XENP16373, XENP16375, XENP16376 and XENP16377. Nucleic acids, expression vectors and host cells are all provided as well, in addition to methods of making these proteins and treating patients with them.

BRIEF DESCRIPTION OF THE DRAWINGS

FIGS. 1A, 1B and 1C depict several formats of the present invention. Two forms of the "bottle opener" format are depicted, one with the anti-CD3 antigen binding domain comprising a scFv and the anti-TTA antigen binding domain comprising a Fab, and one with these reversed. The mAb-Fv, mAb-scFv, Central-scFv and Central-Fv formats are all shown. In addition, "one-armed" formats, where one monomer just comprises an Fc domain, are shown, both a one arm Central-scFv and a one arm Central-Fv. A dual scFv format is also shown.

FIG. 2 depicts the sequences of the "High CD3" anti-CD3_H1.30_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 3 depicts the sequences of the "High-Int #1" Anti-CD3_H1.32_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 4 depicts the sequences of the "High-Int #2" Anti-CD3_H1.89_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 5 depicts the sequences of the "High-Int #3" Anti-CD3_H1.90_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 6 depicts the sequences of the "Int" Anti-CD3_H1.90_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 7 depicts the sequences of the "Low" Anti-CD3_H1.31_L1.47 construct, including the variable heavy and light domains (CDRs underlined), as well as the individual vl and vhCDRs, as well as an scFv construct with a charged linker (double underlined). As is true of all the sequences depicted in the Figures, this charged linker may be replaced by an uncharged linker or a different charged linker, as needed.

FIG. 8 depicts the sequences of the High CD38: OKT10_H1.77_L1.24 construct, including the variable heavy and light domains (CDRs underlined), as well as the individual vl and vhCDRs, as well as an scFv construct with a charged linker (double underlined).

FIG. 9 depicts the sequences of the intermediate CD38: OKT10_H1L1.24 construct, including the variable heavy and light domains (CDRs underlined), as well as the individual vl and vhCDRs, as well as an scFv construct with a charged linker (double underlined).

FIG. 10 depicts the sequences of the Low CD38: OKT10_H1L1 construct, including the variable heavy and light domains (CDRs underlined), as well as the individual vl and vhCDRs, as well as an scFv construct with a charged linker (double underlined).

FIG. 11 depicts the sequences of XENP15331.
FIG. 12 depicts the sequences of XENP13243.
FIG. 13 depicts the sequences of XENP14702.
FIG. 14 depicts the sequences of XENP15426.
FIG. 15 depicts the sequences of XENP14701.
FIG. 16 depicts the sequence of XENP14703.
FIG. 17 depicts the sequence of XENP13243.
FIG. 18 depicts the sequences of XENP18967.
FIG. 19 depicts the sequences of XENP18971.
FIG. 20 depicts the sequences of XENP18969.
FIG. 21 depicts the sequences of XENP18970.
FIG. 22 depicts the sequences of XENP18972.
FIG. 23 depicts the sequences of XENP18973.
FIG. 24 depicts the sequences of XENP15055.
FIG. 25 depicts the sequences of XENP13544.
FIG. 26 depicts the sequences of XENP13694.
FIG. 27 depicts the sequence of human CD3ε.
FIG. 28 depicts the full length (SEQ ID NO:130) and extracellular domain (ECD; SEQ ID NO:131) of the human CD38 protein.

FIG. 29A-29E depict useful pairs of heterodimerization variant sets (including skew and pI variants).

FIG. 30 depict a list of isosteric variant antibody constant regions and their respective substitutions. pI_(−) indicates lower pI variants, while pI_(+) indicates higher pI variants. These can be optionally and independently combined with other heterodimerization variants of the invention (and other variant types as well, as outlined herein).

FIG. 31 depict useful ablation variants that ablate FcγR binding (sometimes referred to as "knock outs" or "KO" variants).

FIG. 32 show two particularly useful embodiments of the invention.

FIGS. 33A and 33B depicts a number of charged scFv linkers that find use in increasing or decreasing the pI of heterodimeric antibodies that utilize one or more scFv as a component. A single prior art scFv linker with a single charge is referenced as "Whitlow", from Whitlow et al., Protein Engineering 6(8):989-995 (1993). It should be noted that this linker was used for reducing aggregation and enhancing proteolytic stability in scFvs.

FIG. 34 depicts a list of engineered heterodimer-skewing Fc variants with heterodimer yields (determined by HPLC-CIEX) and thermal stabilities (determined by DSC). Not determined thermal stability is denoted by "n.d.".

FIG. 39 depicts the sequences of XENP14419,
FIG. 40 depicts the sequences of XENP14420.
FIG. 41 depicts the sequences of XENP14421.
FIG. 42 depicts the sequences of XENP14422.
FIG. 43 depicts the sequences of XENP14423.

FIG. 52 depicts the sequences of XENP15427.
FIG. 53 depicts the sequences of XENP15428.
FIG. 54 depicts the sequences of XENP15429.
FIG. 55 depicts the sequences of XENP15430.
FIG. 56 depicts the sequences of XENP15431.
FIG. 57 depicts the sequences of XENP15432.
FIG. 58 depicts the sequences of XENP15433.
FIG. 59 depicts the sequences of XENP15434.
FIG. 60 depicts the sequences of XENP15435.
FIG. 61 depicts the sequences of XENP15436.
FIG. 62 depicts the sequences of XENP15437.
FIG. 63 depicts the sequences of XENP15438.

FIG. 64 shows binding affinities in a Biacore assay.

FIG. 65 shows the Heterodimer purity during stable pool generation using varied Light chain, Fab-Fc, and scFv-Fc ratios.

FIGS. 67A and 67B depicts stability-optimized, humanized anti-CD3 variant scFvs. Substitutions are given relative to the H1_L1.4 scFv sequence. Amino acid numbering is Kabat numbering.

FIGS. 68A-68Z. Amino acid sequences of stability-optimized, humanized anti-CD3 variant scFvs. CDRs are underlined. For each heavy chain/light chain combination, four sequences are listed: (i) scFv with C-terminal 6×His tag (SEQ ID NO:448), (ii) scFv alone, (iii) VH alone, (iv) VL alone.

FIG. 69 Redirected T cell cytotoxicity assay, 24 h incubation, 10k RPMI8226 cells, 500k PBMC. Test articles are anti-CD38 (OKT10_H1L1, OKT10_H1.77_L1.24)×anti-CD3 Fab-scFv-Fcs. Detection was by LDH.

FIG. 71 depicts the sequences of XENP15049.
FIG. 72 depicts the sequences of XENP15051.
FIG. 73 depicts the sequences of XENP15050.
FIG. 74 depicts the sequences of XENP13676.
FIG. 75 depicts the sequences of XENP14696.
FIG. 76 depicts the sequences of XENP15629.
FIG. 77 depicts the sequences of XENP15053.
FIG. 78 depicts the sequences of XENP15630.
FIG. 79 depicts the sequences of XENP15631.
FIG. 80 depicts the sequences of XENP15632.
FIG. 81 depicts the sequences of XENP15633.
FIG. 82 depicts the sequences of XENP15634.
FIG. 83 depicts the sequences of XENP15635.
FIG. 84 depicts the sequences of XENP15636.
FIG. 85 depicts the sequences of XENP15638.
FIG. 86 depicts the sequences of XENP15639.
FIG. 87 depicts the sequences of XENP13677.
FIG. 88 depicts the sequences of XENP14388.
FIG. 89 depicts the sequences of XENP14389.
FIG. 90 depicts the sequences of XENP14390.
FIG. 91 depicts the sequences of XENP14391.
FIG. 92 depicts the sequences of XENP14392.
FIG. 93 depicts the sequences of XENP14393.
FIG. 94 depicts the sequences of XENP16366.
FIG. 95 depicts the sequences of XENP16367.
FIG. 96 depicts the sequences of XENP16368.
FIG. 97 depicts the sequences of XENP16369.
FIG. 98 depicts the sequences of XENP16370.
FIG. 99 depicts the sequences of XENP16371.
FIG. 100 depicts the sequences of XENP16372.
FIG. 101 depicts the sequences of XENP16373.
FIG. 102 depicts the sequences of XENP16374.
FIG. 103 depicts the sequences of XENP16375.
FIG. 104 depicts the sequences of XENP16376.
FIG. 105 depicts the sequences of XENP16377.
FIG. 106 depicts the sequences of the CD20 and CD123 antigens.

FIG. 111 Surface plasmon resonance determination of CD3 affinity. Test articles are anti-CD20 (C2B8_H1.202_L1.113)×anti-CD3 Fab-scFv-Fcs. Cynomolgus monkey CD3δε-Fc (Sino Biological) was covalently bound to the chip surface. Test articles were passed over at 31.25, 125, 500, and 2000 nM.

FIG. 112 Redirected T cell cytotoxicity assay, 24 h incubation, 10k Ramos cells, 250k PBMC. Test articles are anti-CD20 (C2B8_H1.202_L1.113)×anti-CD3 Fab-scFv-Fcs. Detection was by LDH.

FIGS. 115A and 115B Redirected T cell cytotoxicity assay, 5 h incubation, 20k Jeko cells, 500k PBMC (CD19-depleted). Test articles are anti-CD20 (C2B8_H1L1)×anti-CD3 Fab-scFv-Fcs. Detection was by flow cytometry, specifically the disappearance of CD19$^+$ cells.

FIGS. 116A and 116B Redirected T cell cytotoxicity assay, 24 h incubation, 20k Jeko cells, 500k PBMC (CD19-depleted). Test articles are anti-CD20 (C2B8_H1.202_L1.113)×anti-CD3 Fab-scFv-Fcs. Detection was by flow cytometry, specifically the disappearance of CD19$^+$ cells.

FIG. 117 IL-6 production after 24 h for the experiment described in FIG. 113.

FIG. 118 Redirected T cell cytotoxicity assay, 24 h incubation, 10k RPMI8226 cells, 500k PBMC. Test articles are anti-CD38 (OKT10_H1L1, OKT10_H1.77_L1.24)×anti-CD3 Fab-scFv-Fcs. Detection was by LDH.

FIG. 121 depicts the sequences of High CD20 C2B8_H1.202_L1.113.

FIG. 122 depicts the sequences of Low CD20 C2B8_H1L1.

FIG. 123 depicts the sequences of CD123 7G3_H1.109_L1.57.

FIG. 124 shows a matrix of possible combinations for the invention. An "A" means that the CDRs of the referenced CD3 sequences can be combined with the CDRs of the TTA on the right hand side. That is, the vhCDRs from the variable heavy chain CD3 H1.30 sequence and the vlCDRs from the variable light chain of CD3 L1.57 sequence can be combined with the vhCDRs from the CD38 OKT10 H1.77 sequence and the vlCDRs from the OKT10L1.24 sequence. A "B" means that the CDRs from the CD3 constructs can be combined with the variable heavy and light domains from the TTA. That is, the vhCDRs from the variable heavy chain CD3 H1.30 sequence and the vlCDRs from the variable light chain of CD3 L1.57 sequence can be combined with the variable heavy domain CD38 OKT10 H1.77 sequence and the OKT10L1.24 sequence. A "C" is reversed, such that the variable heavy domain and variable light domain from the CD3 sequences are used with the CDRs of the TTAs. A "D" is where both the variable heavy and variable light chains from each are combined. An "E" is where the scFv of the CD3 is used with the CDRs of the TTA, and an "F" is where the scFv of the CD3 is used with the variable heavy and variable light domains of the TTA antigen binding domain.

FIG. 126. Table showing variants engineered to increase affinity and stability of 7G3_H1L1.

FIG. 127. Table showing the properties of final affinity and stability optimized humanized variants of 7G3.

FIG. 128. Binding of XENP14045 (anti-CD123×anti-CD3) bispecific binding to the CD123 positive AML, cell line KG-1a.

FIG. 130. RTCC of XENP14045 with KG-la cells using different ratios of effector to target (E:T) cells, demonstrating the "serial killing" by T cells generated by XENP14045.

FIG. 136. Sequences of the invention. CDR regions are underlined.

FIG. 137. Heterodimer purity during stable pool generation using varied Light chain, Fab-Fc, and scFv-Fc ratios (top). Heterodimer purity of various conditions of pool F2 (bottom).

FIG. 153 is T cell redistribution.

FIG. 154 is T cell activation.

FIG. 155 is cytokine release.

DETAILED DESCRIPTION OF THE INVENTION

I. Definitions

Figure 1A:
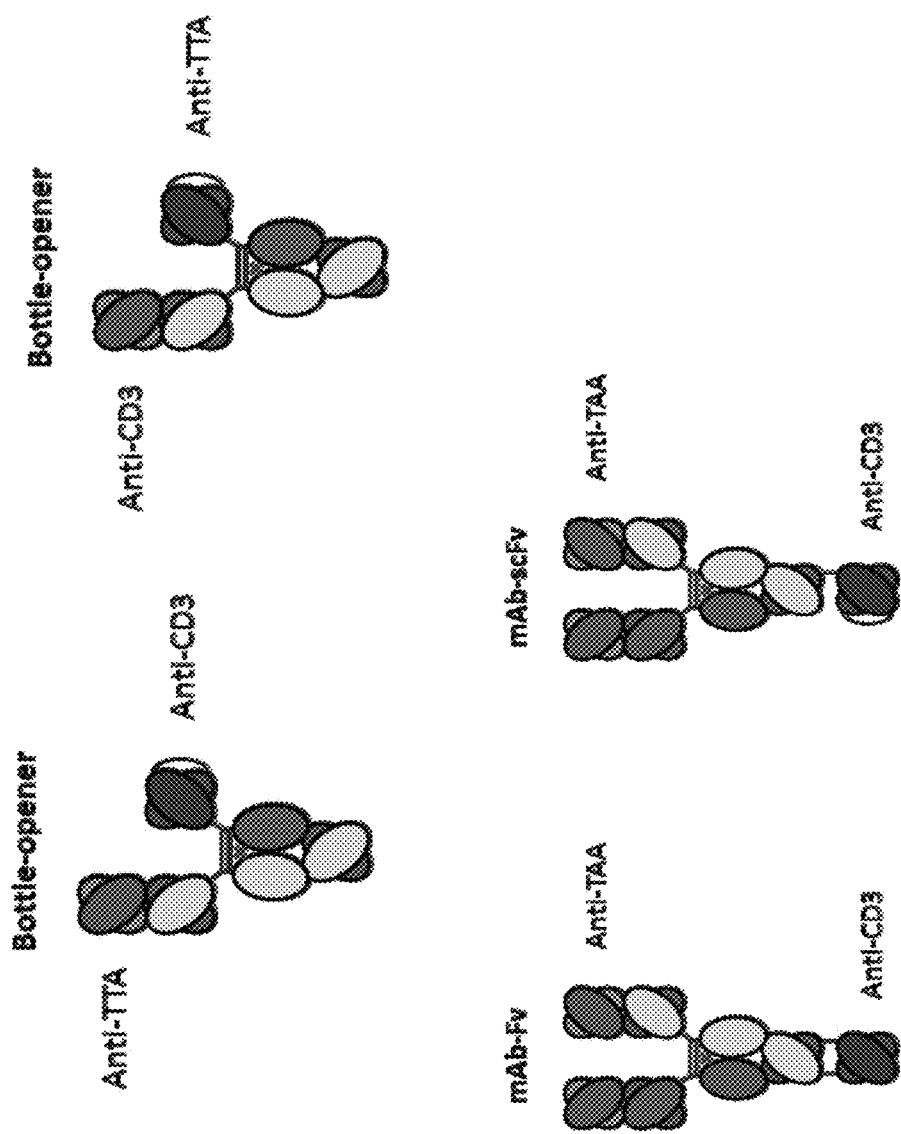

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding are those shown in FIG. 16.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "modification" herein is meant an amino acid substitution, insertion, and/or deletion in a polypeptide sequence or an alteration to a moiety chemically linked to a protein.

For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233– or E233# or E233( ) designates a deletion of glutamic acid at position 233. Additionally, EDA233– or EDA233# designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino acid sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid of FIG. 19. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004-0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. The peptidyl group may comprise naturally occurring amino acids and peptide bonds, or synthetic peptidomimetic structures, i.e. "analogs", such as peptoids (see Simon et al., PNAS USA 89(20):9367 (1992), entirely incorporated by reference). The amino acids may either be naturally occurring or synthetic (e.g. not an amino acid that is coded for by DNA); as will be appreciated by those in the art. For example, homophenylalanine, citrulline, ornithine and norleucine are considered synthetic amino acids for the purposes of the invention, and both D- and L-(R or S) configured amino acids may be utilized. The variants of the present invention may comprise modifications that include the use of synthetic amino acids incorporated using, for example, the technologies developed by Schultz and colleagues, including but not limited to methods described by Cropp & Shultz, 2004, Trends Genet. 20(12):625-30, Anderson et al., 2004, Proc Natl Acad Sci USA 101 (2):7566-71, Zhang et al., 2003, 303(5656):371-3, and Chin et al., 2003, Science 301(5635): 964-7, all entirely incorporated by reference. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. By "Fv" or "Fv fragment" or "Fv region" as used herein is meant a polypeptide that comprises the VL and VH domains of a single antibody. As will be appreciated by those in the art, these generally are made up of two chains.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants used to increase binding to the FcRn receptor, and in some cases, to increase serum half-life, are shown in the Figure Legend of FIG. 83.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding the first constant region immunoglobulin domain and in some cases, part of the hinge. Thus Fc refers to the last two constant region immunoglobulin domains of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "heavy constant region" herein is meant the CH1-hinge-CH2-CH3 portion of an antibody.

By "Fc fusion protein" or "immunoadhesin" herein is meant a protein comprising an Fc region, generally linked (optionally through a linker moiety, as described herein) to a different protein, such as a binding moiety to a target protein, as described herein. In some cases, one monomer of the heterodimeric antibody comprises an antibody heavy chain (either including an scFv or further including a light chain) and the other monomer is a Fc fusion, comprising a variant Fc domain and a ligand. In some embodiments, these "half antibody-half fusion proteins" are referred to as "Fusionbodies".

By "position" as used herein is meant a location in the sequence of a protein. Positions may be numbered sequentially, or according to an established format, for example the EU index for antibody numbering.

By "target antigen" as used herein is meant the molecule that is bound specifically by the variable region of a given antibody. A target antigen may be a protein, carbohydrate, lipid, or other chemical compound. A wide number of suitable target antigens are described below.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g. making the pI higher) then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target cell" as used herein is meant a cell that expresses a target antigen.

By "variable region" as used herein is meant the region of an immunoglobulin that comprises one or more Ig domains substantially encoded by any of the V.kappa., V.lamda., and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The antibodies of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated antibody," refers to an antibody which is substantially free of other antibodies having different antigenic specificities. "Recombinant" means the antibodies are generated using recombinant nucleic acid techniques in exogeneous host cells.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about 10-4 M, at least about 10-5 M, at least about 10-6 M, at least about 10-7 M, at least about 10-8 M, at least about 10-9 M, alternatively at least about 10-10 M, at least about 10-11 M, at least about 10-12 M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction.

II. Overview

Bispecific antibodies that co-engage CD3 and a tumor antigen target have been designed and used to redirect T cells to attack and lyse targeted tumor cells. Examples include the BiTE and DART formats, which monovalently engage CD3 and a tumor antigen. While the CD3-targeting approach has shown considerable promise, a common side effect of such therapies is the associated production of cytokines, often leading to toxic cytokine release syndrome. Because the anti-CD3 binding domain of the bispecific antibody engages all T cells, the high cytokine-producing CD4 T cell subset is recruited. Moreover, the CD4 T cell subset includes regulatory T cells, whose recruitment and expansion can potentially lead to immune suppression and have a negative impact on long-term tumor suppression. In addition, these formats do not contain Fc domains and show very short serum half-lives in patients.

While the CD3-targeting approach has shown considerable promise, a common side effect of such therapies is the associated production of cytokines, often leading to toxic cytokine release syndrome. Because the anti-CD3 binding domain of the bispecific antibody engages all T cells, the high cytokine-producing CD4 T cell subset is recruited. Moreover, the CD4 T cell subset includes regulatory T cells, whose recruitment and expansion can potentially lead to immune suppression and have a negative impact on long-term tumor suppression. One such possible way to reduce cytokine production and possibly reduce the activation of CD4 T cells is by reducing the affinity of the anti-CD3 domain for CD3.

Accordingly, in some embodiments the present invention provides antibody constructs comprising anti-CD3 antigen binding domains that are "strong" or "high affinity" binders to CD3 (e.g. one example are heavy and light variable domains depicted as H1.30_L1.47 (optionally including a charged linker as appropriate)) and also bind to CD38. In other embodiments, the present invention provides antibody constructs comprising anti-CD3 antigen binding domains that are "lite" or "lower affinity" binders to CD3. Additional embodiments provides antibody constructs comprising anti-CD3 antigen binding domains that have intermediate or "medium" affinity to CD3 that also bind to CD38.

It should be appreciated that the "high, medium, low" anti-CD3 sequences of the present invention can be used in a variety of heterodimerization formats. While the majority of the disclosure herein uses the "bottle opener" format of heterodimers, these variable heavy and light sequences, as well as the scFv sequences (and Fab sequences comprising these variable heavy and light sequences) can be used in other formats, such as those depicted in FIG. 2 of WO Publication No. 2014/145806, the Figures, formats and legend of which is expressly incorporated herein by reference.

Accordingly, the present invention provides heterodimeric antibodies that bind to two different antigens, e.g the antibodies are "bispecific", in that they bind two different target antigens, generally target tumor antigens (TTAs) as described below. These heterodimeric antibodies can bind these target antigens either monovalently (e.g. there is a single antigen binding domain such as a variable heavy and variable light domain pair) or bivalently (there are two antigen binding domains that each independently bind the antigen). The heterodimeric antibodies of the invention are based on the use different monomers which contain amino acid substitutions that "skew" formation of heterodimers over homodimers, as is more fully outlined below, coupled with "pI variants" that allow simple purification of the heterodimers away from the homodimers, as is similarly outlined below. For the heterodimeric bispecific antibodies of the invention, the present invention generally relies on the use of engineered or variant Fc domains that can self-assemble in production cells to produce heterodimeric proteins, and methods to generate and purify such heterodimeric proteins.

III. Antibodies

The present invention relates to the generation of bispecific antibodies that bind two different antigens, e.g. CD3 and a target tumor antigen such as CD20, CD38 and CD123, and are generally therapeutic antibodies. As is discussed below, the term "antibody" is used generally. Antibodies that find use in the present invention can take on a number of formats as described herein, including traditional antibodies as well as antibody derivatives, fragments and mimetics, described herein.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to the IgG class, which has several subclasses, including, but not limited to IgG1, IgG2, IgG3, and IgG4. Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publication 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning."

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

It should be noted that the sequences depicted herein start at the CH1 region, position 118; the variable regions are not included except as noted. For example, the first amino acid of SEQ ID NO: 2, while designated as position"1" in the sequence listing, corresponds to position 118 of the CH1 region, according to EU numbering.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined below, is the Fc region.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, FAb domains and scFv domains.

Thus, the "Fc domain" includes the —CH2-CH3 domain, and optionally a hinge domain. The heavy chain comprises a variable heavy domain and a constant domain, which includes a CH1-optional hinge-Fc domain comprising a CH2-CH3. The light chain comprises a variable light chain and the light constant domain.

Some embodiments of the invention comprise at least one scFv domain, which, while not naturally occurring, generally includes a variable heavy domain and a variable light domain, linked together by a scFv linker. As shown herein, there are a number of suitable scFv linkers that can be used, including traditional peptide bonds, generated by recombinant techniques.

The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO:449), (GGGGS)n (SEQ ID NO:450), and (GGGS)n (SEQ ID NO:451), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. While any suitable linker can be used, many embodiments utilize a glycine-serine polymer, including for example (GS)n, (GSGGS)n (SEQ ID NO:449), (GGGGS)n (SEQ ID NO:450), and (GGGS)n (SEQ ID NO:451), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the scFv linker is a charged scFv linker, a number of which are shown in FIG. 33. Accordingly, the present invention further provides charged scFv linkers, to facilitate the separation in pI between a first and a second monomer. That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 33 an be used in any embodiment herein where a linker is utilized.

In some embodiments, the antibodies are full length. By "full length antibody" herein is meant the structure that constitutes the natural biological form of an antibody, including variable and constant regions, including one or more modifications as outlined herein, particularly in the Fc domains to allow either heterodimerization formation or the purification of heterodimers away from homodimers. Full length antibodies generally include Fab and Fc domains, and can additionally contain extra antigen binding domains such as scFvs, as is generally depicted in the Figures.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. For example, Fc fusions are fusions of the Fc region (CH2 and CH3, optionally with the hinge region) fused to another protein. A number of Fc fusions are known the art and can be improved by the addition of the heterodimerization variants of the invention. In the present case, antibody fusions can be made comprising CH1; CH1, CH2 and CH3; CH2; CH3; CH2 and CH3; CH1 and CH3, any or all of which can be made optionally with the hinge region, utilizing any combination of heterodimerization variants described herein.

Figure 1B:
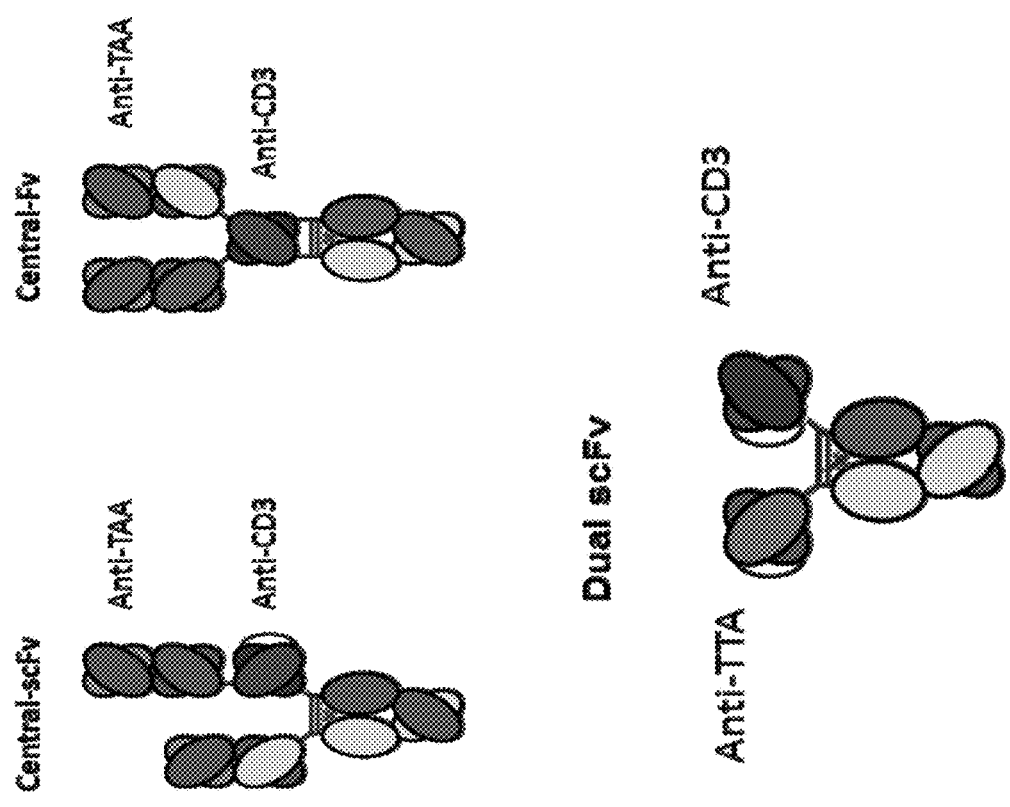

In particular, the formats depicted in FIG. 1 are antibodies, usually referred to as "heterodimeric antibodies", meaning that the protein has at least two associated Fc sequences self-assembled into a heterodimeric Fc domain.

Chimeric and Humanized Antibodies

In some embodiments, the antibody can be a mixture from different species, e.g. a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321:522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180, 370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region. Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

IV. Heterodimeric Antibodies

Accordingly, in some embodiments the present invention provides heterodimeric antibodies that rely on the use of two different heavy chain variant Fc sequences, that will self-assemble to form heterodimeric Fc domains and heterodimeric antibodies.

The present invention is directed to novel constructs to provide heterodimeric antibodies that allow binding to more than one antigen or ligand, e.g. to allow for bispecific binding. The heterodimeric antibody constructs are based on the self-assembling nature of the two Fc domains of the heavy chains of antibodies, e.g. two "monomers" that assemble into a "dimer". Heterodimeric antibodies are made by altering the amino acid sequence of each monomer as more fully discussed below. Thus, the present invention is generally directed to the creation of heterodimeric antibodies which can co-engage antigens in several ways, relying on amino acid variants in the constant regions that are different on each chain to promote heterodimeric formation and/or allow for ease of purification of heterodimers over the homodimers.

Thus, the present invention provides bispecific antibodies. An ongoing problem in antibody technologies is the desire for "bispecific" antibodies that bind to two different antigens simultaneously, in general thus allowing the different antigens to be brought into proximity and resulting in new functionalities and new therapies. In general, these antibodies are made by including genes for each heavy and light chain into the host cells. This generally results in the formation of the desired heterodimer (A-B), as well as the two homodimers (A-A and B-B (not including the light chain heterodimeric issues)). However, a major obstacle in the formation of bispecific antibodies is the difficulty in purifying the heterodimeric antibodies away from the homodimeric antibodies and/or biasing the formation of the heterodimer over the formation of the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some scaffold formats, such as the "triple F" format, also allows separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers.

Additionally, as more fully outlined below, depending on the format of the heterodimer antibody, pI variants can be either contained within the constant and/or Fc domains of a monomer, or charged linkers, either domain linkers or scFv linkers, can be used. That is, scaffolds that utilize scFv(s) such as the Triple F format can include charged scFv linkers (either positive or negative), that give a further pI boost for purification purposes. As will be appreciated by those in the art, some Triple F formats are useful with just charged scFv linkers and no additional pI adjustments, although the invention does provide pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As is outlined more fully below, the pI changes of either or both monomers can be done by removing or adding a charged residue (e.g. a neutral amino acid is replaced by a positively or negatively charged amino acid residue, e.g. glycine to glutamic acid), changing a charged residue from positive or negative to the opposite charge (aspartic acid to lysine) or changing a charged residue to a neutral residue (e.g. loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease it's pI (wt A−+B or wt A−−B), or by increasing one region and decreasing the other region (A+−B− or A−B+).

Thus, in general, a component of some embodiments of the present invention are amino acid variants in the constant regions of antibodies that are directed to altering the isoelectric point (pI) of at least one, if not both, of the monomers of a dimeric protein to form "pI antibodies") by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components, for example in the triple F format, the starting pI of the scFv and Fab of interest. That is, to determine which monomer to engineer or in which "direction" (e.g. more positive or more negative), the Fv sequences of the two target antigens are calculated and a decision is made from there. As is known in the art, different Fvs will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in FIG. 1 for example, several of the formats allow separation of heterodimers and homodimers on the basis of size.

In the case where pI variants are used to achieve heterodimerization, by using the constant region(s) of the heavy chain(s), a more modular approach to designing and purifying bispecific proteins, including antibodies, is provided. Thus, in some embodiments, heterodimerization variants (including skew and purification heterodimerization variants) are not included in the variable regions, such that each individual antibody must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of bispecific antibodies, as the ability to either eliminate, minimize and distinguish when homodimers are present is significant. Similarly, the ability to reliably test the reproducibility of the heterodimeric antibody production is important.

Heterodimerization Variants

The present invention provides heterodimeric proteins, including heterodimeric antibodies in a variety of formats, which utilize heterodimeric variants to allow for heterodimeric formation and/or purification away from homodimers.

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in FIG. 29.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g. these are "monomer corresponding sets) and C220E/P228E/368E paired with C220R/E224R/P228R/K409R.

Figure 37:
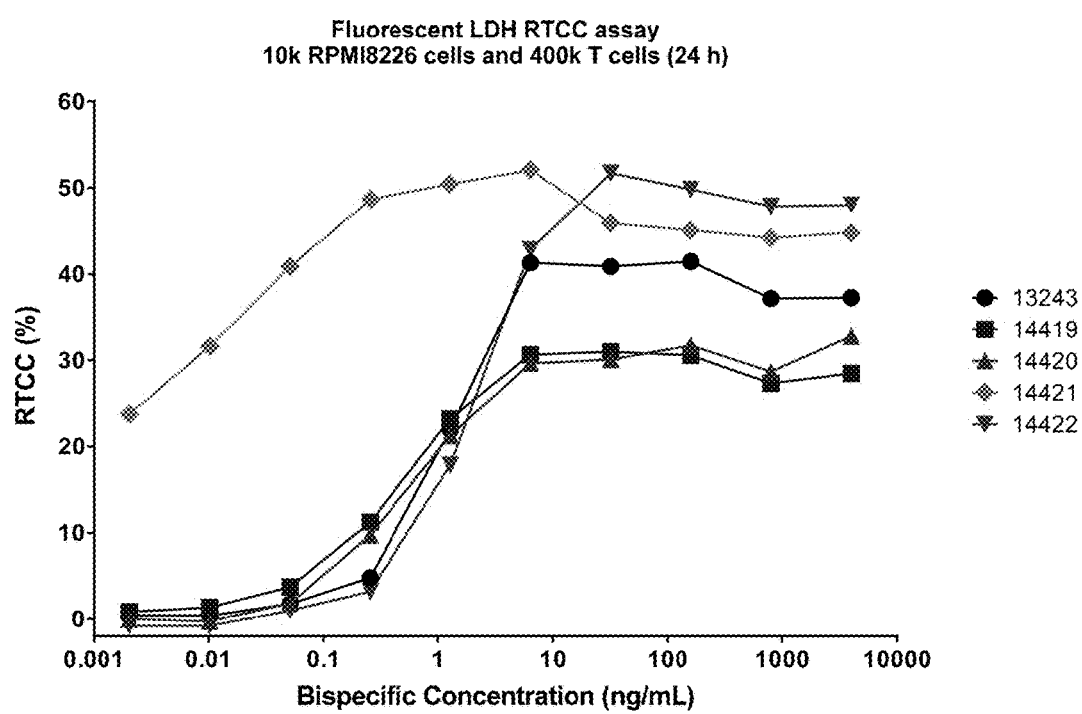
FIG. 37 Redirected T cell cytotoxicity assay, 24 h incubation, 10k RPMI8226 cells, 400k T cells. Test articles are anti-CD38×anti-CD3 bispecifics. Detection was by LDH FIG. 38 Redirected T cell cytotoxicity assay, 24 h incubation, 10k RPMI8226 cells, 500k human PBMCs. Test articles are anti-CD38×anti-CD3 bispecifics. Detection was by LDH.
Figure 38:
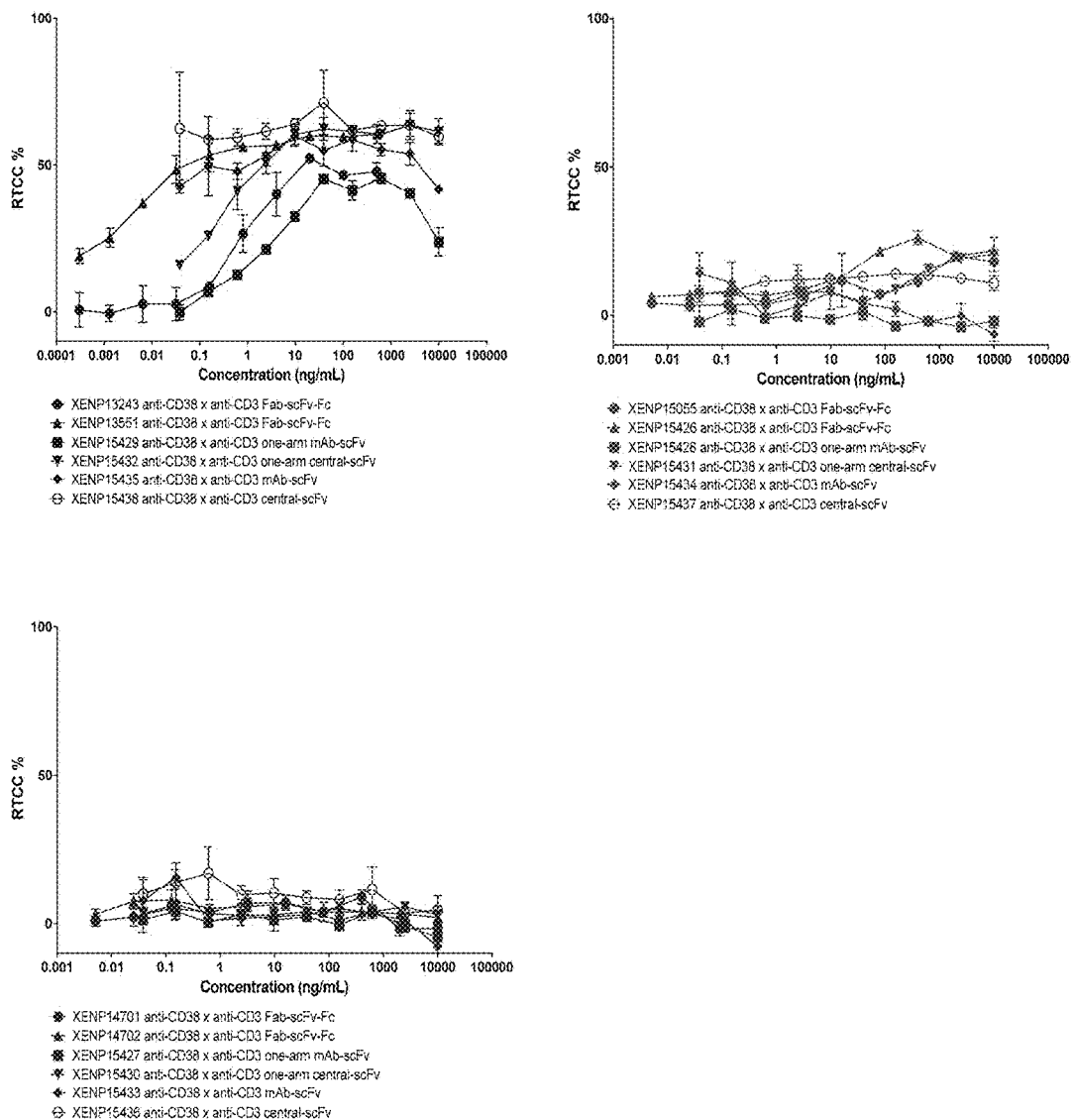

Additional monomer A and monomer B variants that can be combined with other variants, optionally and independently in any amount, such as pI variants outlined herein or other steric variants that are shown in FIG. 37 of US 2012/0149876, the figure and legend and SEQ ID NOs of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 29, with FIG. 34 showing some pairs of particular utility in many embodiments. Of particular use in many embodiments are the pairs of sets including, but not limited to, S364K/E357Q: L368D/K370S; L368D/K370S:S364K; L368E/K370S: S364K; T411T/E360E/Q362E:D401K; L368D/K370S: S364K/E357L and K370S:S364K/E357Q. In terms of nomenclature, the pair "S364K/E357Q:L368D/K370S" means that one of the monomers has the double variant set S364K/E357Q and the other has the double variant set L368D/K370S.

pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 30. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

Antibody Heterodimers Light Chain Variants

In the case of antibody based heterodimers, e.g. where at least one of the monomers comprises a light chain in addition to the heavy chain domain, pI variants can also be made in the light chain. Amino acid substitutions for lowering the pI of the light chain include, but are not limited to, K126E, K126Q, K145E, K145Q, N152D, S156E, K169E, S202E, K207E and adding peptide DEDE (SEQ ID NO:452) at the c-terminus of the light chain. Changes in this category based on the constant lambda light chain include one or more substitutions at R108Q, Q124E, K126Q, N138D, K145T and Q199E. In addition, increasing the pI of the light chains can also be done.

Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant antibody. However, it should be noted as discussed below that even changes in IgG2 molecules allow for increased serum half-life.

In other embodiments, non-isotypic amino acid changes are made, either to reduce the overall charge state of the resulting protein (e.g. by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Pub. 2014/0370013. As discussed herein, which monomer to engineer is generally decided by the inherent pI of the Fv and scaffold regions. Alternatively, the pI of each monomer can be compared.

pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Recently it has been suggested that antibodies with variable regions that have lower isoelectric points may also have longer serum half-lives (Igawa et al., 2010 PEDS. 23(5): 385-392, entirely incorporated by reference). However, the mechanism of this is still poorly understood. Moreover, variable regions differ from antibody to antibody. Constant region variants with reduced pI and extended half-life would provide a more modular approach to improving the pharmacokinetic properties of antibodies, as described herein.

Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

FcγR Variants

Accordingly, there are a number of useful Fc substitutions that can be made to alter binding to one or more of the FcγR receptors. Substitutions that result in increased binding as well as decreased binding can be useful. For example, it is known that increased binding to Fc@RIIIa generally results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, there are additional Fc substitutions that find use in increased binding to the FcRn receptor and increased serum half life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g. FcγR1, FcγRIIa, FcγRIIb, FcγRIIIa, etc.) to avoid additional mechanisms of action. That is, for example, in many embodiments, particularly in the use of bispecific antibodies that bind CD3 monovalently it is generally desirable to ablate FcγRIIIa binding to eliminate or significantly reduce ADCC activity. wherein one of the Fc domains comprises one or more Fcγ receptor ablation variants. These ablation variants are depicted in FIG. 31, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del. It should be noted that the ablation variants referenced herein ablate FcγR binding but generally not FcRn binding.

Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

Useful Formats of the Invention

As will be appreciated by those in the art and discussed more fully below, the heterodimeric fusion proteins of the present invention can take on a wide variety of configurations, as are generally depicted in FIG. 1. Some figures depict "single ended" configurations, where there is one type of specificity on one "arm" of the molecule and a different specificity on the other "arm". Other figures depict "dual ended" configurations, where there is at least one type of specificity at the "top" of the molecule and one or more different specificities at the "bottom" of the molecule. Thus, the present invention is directed to novel immunoglobulin compositions that co-engage a different first and a second antigen.

As will be appreciated by those in the art, the heterodimeric formats of the invention can have different valencies as well as be bispecific. That is, heterodimeric antibodies of the invention can be bivalent and bispecific, wherein one target tumor antigen (e.g. CD3) is bound by one binding domain and the other target tumor antigen (e.g. CD20, CD19, CD38, CD123, etc.) is bound by a second binding domain. The heterodimeric antibodies can also be trivalent and bispecific, wherein the first antigen is bound by two binding domains and the second antigen by a second binding domain. As is outlined herein, when CD3 is one of the target antigens, it is preferable that the CD3 is bound only monovalently, to reduce potential side effects.

The present invention utilizes anti-CD3 antigen binding domains in combination with anti-target tumor antigen (TTA) antigen binding domains. As will be appreciated by those in the art, any collection of anti-CD3 CDRs, anti-CD3 variable light and variable heavy domains, Fabs and scFvs as depicted in any of the Figures (see particularly FIGS. 2 through 7, and FIGS. 68A-68Z) can be used. Similarly, any of the anti-TTA antigen binding domains can be used, e.g. anti-CD38, anti-CD20, anti-CD19 and anti-CD123 antigen binding domains, whether CDRs, variable light and variable heavy domains, Fabs and scFvs as depicted in any of the Figures can be used, optionally and independently combined in any combination.

Bottle Opener Format

One heterodimeric scaffold that finds particular use in the present invention is the "triple F" or "bottle opener" scaffold format as shown in FIGS. 1A, A and B. In this embodiment, one heavy chain of the antibody contains an single chain Fv ("scFv", as defined below) and the other heavy chain is a "regular" FAb format, comprising a variable heavy chain and a light chain. This structure is sometimes referred to herein as "triple F" format (scFv-FAb-Fc) or the "bottle-opener" format, due to a rough visual similarity to a bottle-opener (see FIG. 1). The two chains are brought together by the use of amino acid variants in the constant regions (e.g. the Fc domain, the CH1 domain and/or the hinge region) that promote the formation of heterodimeric antibodies as is described more fully below.

There are several distinct advantages to the present "triple F" format. As is known in the art, antibody analogs relying on two scFv constructs often have stability and aggregation problems, which can be alleviated in the present invention by the addition of a "regular" heavy and light chain pairing. In addition, as opposed to formats that rely on two heavy chains and two light chains, there is no issue with the incorrect pairing of heavy and light chains (e.g. heavy 1 pairing with light 2, etc.).

Many of the embodiments outlined herein rely in general on the bottle opener format that comprises a first monomer comprising an scFv, comprising a variable heavy and a variable light domain, covalently attached using an scFv linker (charged, in many but not all instances), where the scFv is covalently attached to the N-terminus of a first Fc domain usually through a domain linker (which, as outlined herein can either be un-charged or charged). The second monomer of the bottle opener format is a heavy chain, and the composition further comprises a light chain.

In general, in many preferred embodiments, the scFv is the domain that binds to the CD3, with the Fab of the heavy and light chains binding to the other TTA. In addition, the Fc domains of the invention generally comprise skew variants (e.g. a set of amino acid substitutions as shown in FIG. 29 and FIG. 34, with particularly useful skew variants being selected from the group consisting of S364K/E357Q: L368D/K370S; L368D/K370S:S364K; L368E/K370S: S364K; T411T/E360E/Q362E:D401K; L368D/K370S: S364K/E357L and K370S:S364K/E357Q), optionally ablation variants (including those shown in FIG. 31), optionally charged scFv linkers (including those shown in FIG. 33) and the heavy chain comprises pI variants (including those shown in FIG. 30).

The present invention provides bottle opener formats where the anti-CD3 scFv sequences are as shown in FIG. 2 to FIG. 7 and FIGS. 68A-68Z.

The present invention provides bottle opener formats with CD38 antigen binding domains wherein the anti-CD38 sequences are as shown in the Figures, including FIGS. 8 to 10.

The present invention provides bottle opener formats with CD20 antigen binding domains wherein the anti-CD20 sequences are as shown in the Figures.

The present invention provides bottle opener formats with CD19 antigen binding domains wherein the anti-CD19 sequences are as shown in the Figures.

The present invention provides bottle opener formats with CD123 antigen binding domains wherein the anti-CD123 sequences are as shown in the Figures.

mAb-Fv Format

One heterodimeric scaffold that finds particular use in the present invention is the mAb-Fv format shown in FIG. 1. In this embodiment, the format relies on the use of a C-terminal attachment of an "extra" variable heavy domain to one monomer and the C-terminal attachment of an "extra" variable light domain to the other monomer, thus forming a third antigen binding domain, wherein the Fab portions of the two monomers bind a TTA and the "extra" scFv domain binds CD3.

In this embodiment, the first monomer comprises a first heavy chain, comprising a first variable heavy domain and a first constant heavy domain comprising a first Fc domain, with a first variable light domain covalently attached to the C-terminus of the first Fc domain using a domain linker. The second monomer comprises a second variable heavy domain of the second constant heavy domain comprising a second Fc domain, and a third variable heavy domain covalently attached to the C-terminus of the second Fc domain using a domain linker. The two C-terminally attached variable domains make up a scFv that binds CD3. This embodiment further utilizes a common light chain comprising a variable light domain and a constant light domain, that associates with the heavy chains to form two identical Fabs that bind a TTA. As for many of the embodiments herein, these constructs include skew variants, pI variants, ablation variants, additional Fc variants, etc. as desired and described herein.

The present invention provides mAb-Fv formats where the anti-CD3 scFv sequences are as shown in FIG. 2 to FIG. 7 and FIGS. 68A-68Z.

The present invention provides mAb-Fv formats wherein the anti-CD38 sequences are as shown in FIGS. 8 to 10.

The present invention provides mAb-Fv formats with CD20 antigen binding domains wherein the anti-CD20 sequences are as shown in the Figures.

The present invention provides mAb-Fv formats with CD19 antigen binding domains wherein the anti-CD19 sequences are as shown in the Figures.

The present invention provides mAb-Fv formats with CD123 antigen binding domains wherein the anti-CD123 sequences are as shown in the Figures.

The present invention provides mAb-Fv formats comprising ablation variants as shown in FIG. 31.

The present invention provides mAb-Fv formats comprising skew variants as shown in FIGS. 29 and 34.

mAb-scFv

One heterodimeric scaffold that finds particular use in the present invention is the mAb-Fv format shown in FIG. 1. In this embodiment, the format relies on the use of a C-terminal attachment of a scFv to one of the monomers, thus forming a third antigen binding domain, wherein the Fab portions of the two monomers bind a TTA and the "extra" scFv domain binds CD3. Thus, the first monomer comprises a first heavy chain (comprising a variable heavy domain and a constant domain), with a C-terminally covalently attached scFv comprising a scFv variable light domain, an scFv linker and a scFv variable heavy domain. This embodiment further utilizes a common light chain comprising a variable light domain and a constant light domain, that associates with the heavy chains to form two identical Fabs that bind a TTA. As for many of the embodiments herein, these constructs include skew variants, pI variants, ablation variants, additional Fc variants, etc. as desired and described herein.

The present invention provides mAb-Fv formats where the anti-CD3 scFv sequences are as shown in FIG. 2 to FIG. 7 and FIGS. 68A-68Z.

The present invention provides mAb-Fv formats wherein the anti-CD38 sequences are as shown in FIGS. 8 to 10.

The present invention provides mAb-Fv formats with CD20 antigen binding domains wherein the anti-CD20 sequences are as shown in the Figures.

The present invention provides mAb-Fv formats with CD19 antigen binding domains wherein the anti-CD19 sequences are as shown in the Figures.

The present invention provides mAb-Fv formats with CD123 antigen binding domains wherein the anti-CD123 sequences are as shown in the Figures.

The present invention provides mAb-Fv formats comprising ablation variants as shown in FIG. 31.

The present invention provides mAb-Fv formats comprising skew variants as shown in FIGS. 29 and 34.

Central scFv

One heterodimeric scaffold that finds particular use in the present invention is the Central-scFv format shown in FIG. 1. In this embodiment, the format relies on the use of an inserted scFv domain thus forming a third antigen binding domain, wherein the Fab portions of the two monomers bind a TTA and the "extra" scFv domain binds CD3. The scFv domain is inserted between the Fc domain and the CH1-Fv region of one of the monomers, thus providing a third antigen binding domain.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers. This embodiment further utilizes a common light chain comprising a variable light domain and a constant light domain, that associates with the heavy chains to form two identical Fabs that bind a TTA. As for many of the embodiments herein, these constructs include skew variants, pI variants, ablation variants, additional Fc variants, etc. as desired and described herein.

The present invention provides Central-scFv formats where the anti-CD3 scFv sequences are as shown in FIG. 2 to FIG. 7 and FIGS. 68A-68Z.

The present invention provides Central-scFv formats wherein the anti-CD38 sequences are as shown in FIGS. 8 to 10.

The present invention provides Central-scFv formats with CD20 antigen binding domains wherein the anti-CD20 sequences are as shown in the Figures.

The present invention provides Central-scFv formats with CD19 antigen binding domains wherein the anti-CD19 sequences are as shown in the Figures.

The present invention provides Central-scFv formats with CD123 antigen binding domains wherein the anti-CD123 sequences are as shown in v The present invention provides Central-scFv formats comprising ablation variants as shown in FIG. 31.

The present invention provides Central-scFv formats comprising skew variants as shown in FIGS. 29 and 34.

Central-Fv Format

One heterodimeric scaffold that finds particular use in the present invention is the Central-Fv format shown in FIG. 1. In this embodiment, the format relies on the use of an inserted scFv domain thus forming a third antigen binding domain, wherein the Fab portions of the two monomers bind a TTA and the "extra" scFv domain binds CD3. The scFv domain is inserted between the Fc domain and the CH1-Fv region of the monomers, thus providing a third antigen binding domain, wherein each monomer contains a component of the scFv (e.g. one monomer comprises a variable heavy domain and the other a variable light domain).

In this embodiment, one monomer comprises a first heavy chain comprising a first variable heavy domain, a CH1 domain and Fc domain and an additional variable light domain. The light domain is covalently attached between the C-terminus of the CH1 domain of the heavy constant domain and the N-terminus of the first Fc domain using domain linkers. The other monomer comprises a first heavy chain comprising a first variable heavy domain, a CH1 domain and Fc domain and an additional variable heavy domain. The light domain is covalently attached between the C-terminus of the CH1 domain of the heavy constant domain and the N-terminus of the first Fc domain using domain linkers.

This embodiment further utilizes a common light chain comprising a variable light domain and a constant light domain, that associates with the heavy chains to form two identical Fabs that bind a TTA. As for many of the embodiments herein, these constructs include skew variants, pI variants, ablation variants, additional Fc variants, etc. as desired and described herein.

The present invention provides Central-Fv formats where the anti-CD3 scFv sequences are as shown in FIG. 2 to FIG. 7 and FIGS. 68A-68Z.

The present invention provides Central-Fv formats wherein the anti-CD38 sequences are as shown in FIGS. 8 to 10.

The present invention provides Central-Fv formats with CD20 antigen binding domains wherein the anti-CD20 sequences are as shown in the Figures.

The present invention provides Central-Fv formats with CD19 antigen binding domains wherein the anti-CD19 sequences are as shown in the Figures.

The present invention provides Central-Fv formats with CD123 antigen binding domains wherein the anti-CD123 sequences are as shown in the Figures.

The present invention provides Central-Fv formats comprising ablation variants as shown in FIG. 31.

The present invention provides Central-Fv formats comprising skew variants as shown in FIGS. 29 and 34.

One Armed Central-scFv

One heterodimeric scaffold that finds particular use in the present invention is the one armed central-scFv format shown in FIG. 1. In this embodiment, one monomer comprises just an Fc domain, while the other monomer uses an inserted scFv domain thus forming the second antigen binding domain. In this format, either the Fab portion binds a TTA and the scFv binds CD3 or vice versa. The scFv domain is inserted between the Fc domain and the CH1-Fv region of one of the monomers.

In this embodiment, one monomer comprises a first heavy chain comprising a first variable heavy domain, a CH1 domain and Fc domain, with a scFv comprising a scFv variable light domain, an scFv linker and a scFv variable heavy domain. The scFv is covalently attached between the C-terminus of the CH1 domain of the heavy constant domain and the N-terminus of the first Fc domain using domain linkers. The second monomer comprises an Fc domain. This embodiment further utilizes a light chain comprising a variable light domain and a constant light domain, that associates with the heavy chain to form a Fab. As for many of the embodiments herein, these constructs include skew variants, pI variants, ablation variants, additional Fc variants, etc. as desired and described herein.

The present invention provides one armed central-scFv formats where the anti-CD3 scFv sequences are as shown in FIG. 2 to FIG. 7 and FIGS. 68A-68Z.

The present invention provides one armed central-scFv formats wherein the anti-CD38 sequences are as shown in FIGS. 8 to 10.

The present invention provides one armed central-scFv formats with CD20 antigen binding domains wherein the anti-CD20 sequences are as shown in the Figures.

The present invention provides one armed central-scFv formats with CD19 antigen binding domains wherein the anti-CD19 sequences are as shown in the Figures.

The present invention provides one armed central-scFv formats with CD123 antigen binding domains wherein the anti-CD123 sequences are as shown in the Figures.

The present invention provides one armed central-scFv formats comprising ablation variants as shown in FIG. 31.

The present invention provides one armed central-scFv formats comprising skew variants as shown in FIGS. 29 and 34.

Dual scFv Formats

The present invention also provides dual scFv formats as are known in the art and shown in FIG. 1.

The present invention provides dual scFv formats where the anti-CD3 scFv sequences are as shown in FIG. 2 to FIG. 7 and FIGS. 68A-68Z.

The present invention provides dual scFv formats wherein the anti-CD38 sequences are as shown in FIGS. 8 to 10.

The present invention provides dual scFv formats with CD20 antigen binding domains wherein the anti-CD20 sequences are as shown in the Figures.

The present invention provides dual scFv formats with CD19 antigen binding domains wherein the anti-CD19 sequences are as shown in the Figures.

The present invention provides dual scFv formats with CD123 antigen binding domains wherein the anti-CD123 sequences are as shown in the Figures.

The present invention provides dual scFv formats comprising ablation variants as shown in FIG. 31.

The present invention provides dual scFv formats comprising skew variants as shown in FIGS. 29 and 34.

Target Antigens

The bispecific antibodies of the invention have two different antigen binding domains: one that binds to CD3 (generally monovalently), and one that binds to a target tumor antigen (sometimes referred to herein as "TTA"). Suitable target tumor antigens include, but are not limited to, CD20, CD38, CD123; ROR1, ROR2, BCMA; PSMA; SSTR2; SSTR5, CD19, FLT3, CD33, PSCA, ADAM 17, CEA, Her2, EGFR, EGFR-vIII, CD30, FOLR1, GD-2, CA-IX, Trop-2, CD70, CD38, mesothelin, EphA2, CD22, CD79b, GPNMB, CD56, CD138, CD52, CD74, CD30, CD123, RON, ERBB2, and EGFR.

The "triple F" format is particularly beneficial for targeting two (or more) distinct antigens. (As outlined herein, this targeting can be any combination of monovalent and divalent binding, depending on the format). Thus the immunoglobulins herein preferably co-engage two target antigens. Each monomer's specificity can be selected from the lists herein. Additional useful bispecific formats for use with an anti-CD3 binding domain are shown in FIG. 1.

Particular suitable applications of the heterodimeric antibodies herein are co-target pairs for which it is beneficial or critical to engage each target antigen monovalently. Such antigens may be, for example, immune receptors that are activated upon immune complexation. Cellular activation of many immune receptors occurs only by cross-linking, achieved typically by antibody/antigen immune complexes, or via effector cell to target cell engagement. For some immune receptors, for example the CD3 signaling receptor on T cells, activation only upon engagement with co-engaged target is critical, as nonspecific cross-linking in a clinical setting can elicit a cytokine storm and toxicity. Therapeutically, by engaging such antigens monovalently rather than multivalently, using the immunoglobulins herein, such activation occurs only in response to cross-linking only in the microenvironment of the primary target antigen. The ability to target two different antigens with different valencies is a novel and useful aspect of the present invention. Examples of target antigens for which it may be therapeutically beneficial or necessary to co-engage monovalently include but are not limited to immune activating receptors such as CD3, FcγRs, toll-like receptors (TLRs) such as TLR4 and TLR9, cytokine, chemokine, cytokine receptors, and chemokine receptors. In many embodiments, one of the antigen binding sites binds to CD3, and in some embodiments it is the scFv-containing monomer.

Virtually any antigen may be targeted by the immunoglobulins herein, including but not limited to proteins, subunits, domains, motifs, and/or epitopes belonging to the following list of target antigens, which includes both soluble factors such as cytokines and membrane-bound factors, including transmembrane receptors: 17-IA, 4-1BB, 4Dc, 6-keto-PGF1a, 8-iso-PGF2a, 8-oxo-dG, A1 Adenosine Receptor, A33, ACE, ACE-2, Activin, Activin A, Activin AB, Activin B, Activin C, Activin RIA, Activin RIA ALK-2, Activin RIB ALK-4, Activin RIIA, Activin RIIB, ADAM, ADAM10, ADAM12, ADAM15, ADAM17/TACE, ADAMS, ADAMS, ADAMTS, ADAMTS4, ADAMTS5, Addressins, aFGF, ALCAM, ALK, ALK-1, ALK-7, alpha-1-antitrypsin, alpha-V/beta-1 antagonist, ANG, Ang, APAF-1, APE, APJ, APP, APRIL, AR, ARC, ART, Artemin, anti-Id, ASPARTIC, Atrial natriuretic factor, av/b3 integrin, Axl, b2M, B7-1, B7-2, B7-H, B-lymphocyte Stimulator (BlyS), BACE, BACE-1, Bad, BAFF, BAFF-R, Bag-1, BAK, Bax, BCA-1, BCAM, Bcl, BCMA, BDNF, b-ECGF, bFGF, BID, Bik, BIM, BLC, BL-CAM, BLK, BMP, BMP-2 BMP-2a, BMP-3 Osteogenin, BMP-4 BMP-2b, BMP-5, BMP-6 Vgr-1, BMP-7 (OP-1), BMP-8 (BMP-8a, OP-2), BMPR, BMPR-IA (ALK-3), BMPR-IB (ALK-6), BRK-2, RPK-1, BMPR-II (BRK-3), BMPs, b-NGF, BOK, Bombesin, Bone-derived neurotrophic factor, BPDE, BPDE-DNA, BTC, complement factor 3 (C3), C3a, C4, C5, C5a, C10, CA125, CAD-8, Calcitonin, cAMP, carcinoembryonic antigen (CEA), carcinoma-associated antigen, Cathepsin A, Cathepsin B, Cathepsin C/DPPI, Cathepsin D, Cathepsin E, Cathepsin H, Cathepsin L, Cathepsin O, Cathepsin S, Cathepsin V, Cathepsin X/Z/P, CBL, CCI, CCK2, CCL, CCL1, CCL11, CCL12, CCL13, CCL14, CCL15, CCL16, CCL17, CCL18, CCL19, CCL2, CCL20, CCL21, CCL22, CCL23, CCL24, CCL25, CCL26, CCL27, CCL28, CCL3, CCL4, CCL5, CCL6, CCL7, CCL8, CCL9/10, CCR, CCR1, CCR10, CCR10, CCR2, CCR3, CCR4, CCR5, CCR6, CCR7, CCR8, CCR9, CD1, CD2, CD3, CD3E, CD4, CD5, CD6, CD7, CD8, CD10, CD11a, CD11b, CD11c, CD13, CD14, CD15, CD16, CD18, CD19, CD20, CD21, CD22, CD23, CD25, CD27L, CD28, CD29, CD30, CD30L, CD32, CD33 (p67 proteins), CD34, CD38, CD40, CD40L, CD44, CD45, CD46, CD49a, CD52, CD54, CD55, CD56, CD61, CD64, CD66e, CD74, CD80 (B7-1), CD89, CD95, CD123, CD137, CD138, CD140a, CD146, CD147, CD152, CD164, CEACAM5, CFTR, cGMP, CINC, *Clostridium botulinum* toxin, *Clostridium perfringens* toxin, CKb8-1, CLC, CMV, CMV UL, CNTF, CNTN-1, COX, C-Ret, CRG-2, CT-1, CTACK, CTGF, CTLA-4, CX3CL1, CX3CR1, CXCL, CXCL1, CXCL2, CXCL3, CXCL4, CXCL5, CXCL6, CXCL7, CXCL8, CXCL9, CXCL10, CXCL11, CXCL12, CXCL13, CXCL14, CXCL15, CXCL16, CXCR, CXCR1, CXCR2, CXCR3, CXCR4, CXCR5, CXCR6, cytokeratin tumor-associated antigen, DAN, DCC, DcR3, DC-SIGN, Decay accelerating factor, des(1-3)-IGF-I (brain IGF-1), Dhh, digoxin, DNAM-1, Dnase, Dpp, DPPIV/CD26, Dtk, ECAD, EDA, EDA-A1, EDA-A2, EDAR, EGF, EGFR (ErbB-1), EMA, EMMPRIN, ENA, endothelin receptor, Enkephalinase, eNOS, Eot, eotaxin1, EpCAM, Ephrin B2/EphB4, EPO, ERCC, E-selectin, ET-1, Factor Ha, Factor VII, Factor VIIIc, Factor IX, fibroblast activation protein (FAP), Fas, FcR1, FEN-1, Ferritin, FGF, FGF-19, FGF-2, FGF3, FGF-8, FGFR, FGFR-3, Fibrin, FL, FLIP, Flt-3, Flt-4, Follicle stimulating hormone, Fractalkine, FZD1, FZD2, FZD3, FZD4, FZD5, FZD6, FZD7, FZD8, FZD9, FZD10, G250, Gas 6, GCP-2, GCSF, GD2, GD3, GDF, GDF-1, GDF-3 (Vgr-2), GDF-5 (BMP-14, CDMP-1), GDF-6 (BMP-13, CDMP-2), GDF-7 (BMP-12, CDMP-3), GDF-8 (Myostatin), GDF-9, GDF-15 (MIC-1), GDNF, GDNF, GFAP, GFRa-1, GFR-alpha1, GFR-alpha2, GFR-alpha3, GITR, Glucagon, Glut 4, glycoprotein IIb/IIIa (GP IIb/IIIa), GM-CSF, gp130, gp72, GRO, Growth hormone releasing factor, Hapten (NP-cap or NIP-cap), HB-EGF, HCC, HCMV gB envelope glycoprotein, HCMV) gH envelope glycoprotein, HCMV UL, Hemopoietic growth factor (HGF), Hep B gp120, heparanase, Her2, Her2/neu (ErbB-2), Her3 (ErbB-3), Her4 (ErbB-4), herpes simplex virus (HSV) gB glycoprotein, HSV gD glycoprotein, HGFA, High molecular weight melanoma-associated antigen (HMW-MAA), HIV gp120, HIV IIIB gp 120 V3 loop, HLA, HLA-DR, HM1.24, HMFG PEM, HRG, Hrk, human cardiac myosin, human cytomegalovirus (HCMV), human growth hormone (HGH), HVEM, 1-309, IAP, ICAM, ICAM-1, ICAM-3, ICE, ICOS, IFNg, Ig, IgA receptor, IgE, IGF, IGF binding proteins, IGF-1R, IGFBP, IGF-I, IGF-II, IL, IL-1, IL-1R, IL-2, IL-2R, IL-4, IL-4R, IL-5, IL-5R, IL-6, IL-6R, IL-8, IL-9, IL-10, IL-12, IL-13, IL-15, IL-18, IL-18R, IL-23, interferon (INF)-alpha, INF-beta, INF-gamma, Inhibin, iNOS, Insulin A-chain, Insulin B-chain, Insulin-like growth factor 1, integrin alpha2, integrin alpha3, integrin alpha4, integrin alpha4/beta1, integrin alpha4/beta7, integrin alpha5 (alphaV), integrin alpha5/beta1, integrin alpha5/beta3, integrin alpha6, integrin beta1, integrin beta2, interferon gamma, IP-10, I-TAC, JE, Kallikrein 2, Kallikrein 5, Kallikrein 6, Kallikrein 11, Kallikrein 12, Kallikrein 14, Kallikrein 15, Kallikrein L1, Kallikrein L2, Kallikrein L3, Kallikrein L4, KC, KDR, Keratinocyte Growth Factor (KGF), laminin 5, LAMP, LAP, LAP (TGF-1), Latent TGF-1, Latent TGF-1 bp1, LBP, LDGF, LECT2, Lefty, Lewis-Y antigen, Lewis-Y related antigen, LFA-1, LFA-3, Lfo, LIF, LIGHT, lipoproteins, LIX, LKN, Lptn, L-Selectin, LT-a, LT-b, LTB4, LTBP-1, Lung surfactant, Luteinizing hormone, Lymphotoxin Beta Receptor, Mac-1, MAdCAM, MAG, MAP2, MARC, MCAM, MCAM, MCK-2, MCP, M-CSF, MDC, Mer, METALLOPROTEASES, MGDF receptor, MGMT, MHC (HLA-DR), MIF, MIG, MIP, MIP-1-alpha, MK, MMAC1, MMP, MMP-1, MMP-10, MMP-11, MMP-12, MMP-13, MMP-14, MMP-15, MMP-2, MMP-24, MMP-3, MMP-7, MMP-8, MMP-9, MPIF, Mpo, MSK, MSP, mucin (Muc1), MUC18, Muellerian-inhibitin substance, Mug, MuSK, NAIP, NAP, NCAD, N-Cadherin, NCA 90, NCAM, NCAM, Neprilysin, Neurotrophin-3, -4, or -6, Neurturin, Neuronal growth factor (NGF), NGFR, NGF-beta, nNOS, NO, NOS, Npn, NRG-3, NT, NTN, OB, OGG1, OPG, OPN, OSM, OX40L, OX40R, p150, p95, PADPr, Parathyroid hormone, PARC, PARP, PBR, PBSF, PCAD, P-Cadherin, PCNA, PDGF, PDGF, PDK-1, PECAM, PEM, PF4, PGE, PGF, PGI2, PGJ2, PIN, PLA2, placental alkaline phosphatase (PLAP), PlGF, PLP, PP14, Proinsulin, Prorelaxin, Protein C, PS, PSA, PSCA, prostate specific membrane antigen (PSMA), PTEN, PTHrp, Ptk, PTN, R51, RANK, RANKL, RANTES, RANTES, Relaxin A-chain, Relaxin B-chain, renin, respiratory syncytial virus (RSV) F, RSV Fgp, Ret, Rheumatoid factors, RLIP76, RPA2, RSK, S100, SCF/KL, SDF-1, SERINE, Serum albumin, sFRP-3, Shh, SIGIRR, SK-1, SLAM, SLPI, SMAC, SMDF, SMOH, SOD, SPARC, Stat, STEAP, STEAP-II, TACE, TACI, TAG-72 (tumor-associated glycoprotein-72), TARC, TCA-3, T-cell receptors (e.g., T-cell receptor alpha/beta), TdT, TECK, TEM1, TEM5, TEM7, TEM8, TERT, testicular PLAP-like alkaline phosphatase, TfR, TGF, TGF-alpha, TGF-beta, TGF-beta Pan Specific, TGF-beta RI (ALK-5), TGF-beta RII, TGF-beta RIIb, TGF-beta RIII, TGF-beta1, TGF-beta2, TGF-beta3, TGF-beta4, TGF-beta5, Thrombin, Thymus Ck-1, Thyroid stimulating hormone, Tie, TIMP, TIQ, Tissue Factor, TMEFF2, Tmpo, TMPRSS2, TNF, TNF-alpha, TNF-alpha beta, TNF-beta2, TNFc, TNF-RI, TNF-RII, TNFRSF10A (TRAIL R1 Apo-2, DR4), TNFRSF10B (TRAIL R2 DR5, KILLER, TRICK-2A, TRICK-B), TNFRSF10C (TRAIL R3 DcR1, LIT, TRID), TNFRSF10D (TRAIL R4 DcR2, TRUNDD), TNFRSF11A (RANK ODF R, TRANCE R), TNFRSF11B (OPG OCIF, TR1), TNFRSF12 (TWEAK R FN14), TNFRSF13B (TACI), TNFRSF13C (BAFF R), TNFRSF14 (HVEM ATAR, HveA, LIGHT R, TR2), TNFRSF16 (NGFR p75NTR), TNFRSF17 (BCMA), TNFRSF18 (GITR AITR), TNFRSF19 (TROY TAJ, TRADE), TNFRSF19L (RELT), TNFRSF1A (TNF RI CD120a, p55-60), TNFRSF1B (TNF RII CD120b, p75-80), TNFRSF26 (TNFRH3), TNFRSF3 (LTbR TNF RIII, TNFC R), TNFRSF4 (OX40 ACT35, TXGP1R), TNFRSF5 (CD40 p50), TNFRSF6 (Fas Apo-1, APT1, CD95), TNFRSF6B (DcR3 M68, TR6), TNFRSF7 (CD27), TNFRSF8 (CD30), TNFRSF9 (4-1BB CD137, ILA), TNFRSF21 (DR6), TNFRSF22 (DcTRAIL R2 TNFRH2), TNFRST23 (DcTRAIL R1 TNFRH1), TNFRSF25 (DR3 Apo-3, LARD, TR-3, TRAMP, WSL-1), TNFSF10 (TRAIL Apo-2 Ligand, TL2), TNFSF11 (TRANCE/RANK Ligand ODF, OPG Ligand), TNFSF12 (TWEAK Apo-3 Ligand, DR3 Ligand), TNFSF13 (APRIL TALL2), TNFSF13B (BAFF BLYS, TALL1, THANK, TNFSF20), TNFSF14 (LIGHT HVEM Ligand, LTg), TNFSF15 (TL1A/VEGI), TNFSF18 (GITR Ligand AITR Ligand, TL6), TNFSF1A (TNF-a Conectin, DIF, TNFSF2), TNFSF1B (TNF-b LTa, TNFSF1), TNFSF3 (LTb TNFC, p33), TNFSF4 (OX40 Ligand gp34, TXGP1), TNFSF5 (CD40 Ligand CD154, gp39, HIGM1, IMD3, TRAP), TNFSF6 (Fas Ligand Apo-1 Ligand, APT1 Ligand), TNFSF7 (CD27 Ligand CD70), TNFSF8 (CD30 Ligand CD153), TNFSF9 (4-1BB Ligand CD137 Ligand), TP-1, t-PA, Tpo, TRAIL, TRAIL R, TRAIL-R1, TRAIL-R2, TRANCE, transferring receptor, TRF, Trk, TROP-2, TSG, TSLP, tumor-associated antigen CA 125, tumor-associated antigen expressing Lewis Y related carbohydrate, TWEAK, TXB2, Ung, uPAR, uPAR-1, Urokinase, VCAM, VCAM-1, VECAD, VE-Cadherin, VE-cadherin-2, VEFGR-1 (flt-1), VEGF, VEGFR, VEGFR-3 (flt-4), VEGI, VIM, Viral antigens, VLA, VLA-1, VLA-4, VNR integrin, von Willebrands factor, WIF-1, WNT1, WNT2, WNT2B/13, WNT3, WNT3A, WNT4, WNT5A, WNT5B, WNT6, WNT7A, WNT7B, WNT8A, WNT8B, WNT9A, WNT9A, WNT9B, WNT10A, WNT10B, WNT11, WNT16, XCL1, XCL2, XCR1, XCR1, XEDAR, XIAP, XPD, and receptors for hormones and growth factors.

Exemplary antigens that may be targeted specifically by the immunoglobulins of the invention include but are not limited to: CD20, CD19, Her2, EGFR, EpCAM, CD3, FcγRIIIa (CD16), FcγRIIa (CD32a), FcγRIIb (CD32b), FcγRI (CD64), Toll-like receptors (TLRs) such as TLR4 and TLR9, cytokines such as IL-2, IL-5, IL-13, IL-12, IL-23, and TNFα, cytokine receptors such as IL-2R, chemokines, chemokine receptors, growth factors such as VEGF and HGF, and the like. To form the bispecific antibodies of the invention, antibodies to any combination of these antigens can be made; that is, each of these antigens can be optionally and independently included or excluded from a bispecific antibody according to the present invention.

Particularly preferred combinations for bispecific antibodies are an antigen-binding domain to CD3 and an antigen binding domain selected from a domain that binds CD19, CD20, CD38 and CD123, the sequences of which are shown in the Figures.

Nucleic Acids of the Invention

The invention further provides nucleic acid compositions encoding the bispecific antibodies of the invention. As will be appreciated by those in the art, the nucleic acid compositions will depend on the format and scaffold of the heterodimeric protein. Thus, for example, when the format requires three amino acid sequences, such as for the triple F format (e.g. a first amino acid monomer comprising an Fc domain and a scFv, a second amino acid monomer comprising a heavy chain and a light chain), three nucleic acid sequences can be incorporated into one or more expression vectors for expression. Similarly, some formats (e.g. dual scFv formats such as disclosed in FIG. 1) only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer and the optional nucleic acid encoding a light chain, as applicable depending on the format, are each contained within a single expression vector, generally under different or the same promoter controls. In embodiments of particular use in the present invention, each of these two or three nucleic acids are contained on a different expression vector. As shown herein and in 62/025,931, hereby incorporated by reference, different vector ratios can be used to drive heterodimer formation. That is, surprisingly, while the proteins comprise first monomer:second monomer:light chains (in the case of many of the embodiments herein that have three polypeptides comprising the heterodimeric antibody) in a 1:1:2 ratio, these are not the ratios that give the best results. See Error! Reference source not found.

The heterodimeric antibodies of the invention are made by culturing host cells comprising the expression vector(s) as is well known in the art. Once produced, traditional antibody purification steps are done, including an ion exchange chromotography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the "triple F" heterodimer (e.g., anionic exchange columns, cationic exchange columns). These substitutions also aid in the determination and monitoring of any contaminating dual scFv-Fc and mAb homodimers post-purification (e.g., IEF gels, cIEF, and analytical IEX columns).

Treatments

Once made, the compositions of the invention find use in a number of applications. CD20, CD38 and CD123 are all unregulated in many hematopoeitic malignancies and in cell lines derived from various hematopoietic malignancies, accordingly, the heterodimeric antibodies of the invention find use in treating cancer, including but not limited to, all B cell lymphomas and leukemias, including but not limited to non-Hodgkin's lymphoma (NHL), Burkitt's lymphoma (BL), multiple myeloma (MM), B chronic lymphocytic leukemia (B-CLL), B and T acute lymphocytic leukemia (ALL), T cell lymphoma (TCL), acute myeloid leukemia (AML), hairy cell leukemia (HCL), Hodgkin's Lymphoma (HL), chronic lymphocytic leukemia (CLL), non-Hodgkin's lymphoma, and chronic myeloid leukemia (CML).

Accordingly, the heterodimeric compositions of the invention find use in the treatment of these cancers.

Antibody Compositions for In Vivo Administration

Formulations of the antibodies used in accordance with the present invention are prepared for storage by mixing an antibody having the desired degree of purity with optional pharmaceutically acceptable carriers, excipients or stabilizers (Remington's Pharmaceutical Sciences 16th edition, Osol, A. Ed. [1980]), in the form of lyophilized formulations or aqueous solutions. Acceptable carriers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

The formulation herein may also contain more than one active compound as necessary for the particular indication being treated, preferably those with complementary activities that do not adversely affect each other. For example, it may be desirable to provide antibodies with other specificities. Alternatively, or in addition, the composition may comprise a cytotoxic agent, cytokine, growth inhibitory agent and/or small molecule antagonist. Such molecules are suitably present in combination in amounts that are effective for the purpose intended.

The active ingredients may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are disclosed in Remington's Pharmaceutical Sciences 16th edition, Osol, A. Ed. (1980).

The formulations to be used for in vivo administration should be sterile, or nearly so. This is readily accomplished by filtration through sterile filtration membranes.

Sustained-release preparations may be prepared. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinylalcohol)), polylactides (U.S. Pat. No. 3,773,919), copolymers of L-glutamic acid and .gamma. ethyl-L-glutamate, non-degradable ethylene-vinyl acetate, degradable lactic acid-glycolic acid copolymers such as the LUPRON DEPOT™ (injectable microspheres composed of lactic acid-glycolic acid copolymer and leuprolide acetate), and poly-D-(−)-3-hydroxybutyric acid. While polymers such as ethylene-vinyl acetate and lactic acid-glycolic acid enable release of molecules for over 100 days, certain hydrogels release proteins for shorter time periods.

When encapsulated antibodies remain in the body for a long time, they may denature or aggregate as a result of exposure to moisture at 37° C., resulting in a loss of biological activity and possible changes in immunogenicity. Rational strategies can be devised for stabilization depending on the mechanism involved. For example, if the aggregation mechanism is discovered to be intermolecular S—S bond formation through thio-disulfide interchange, stabilization may be achieved by modifying sulfhydryl residues, lyophilizing from acidic solutions, controlling moisture content, using appropriate additives, and developing specific polymer matrix compositions.

Administrative Modalities

The antibodies and chemotherapeutic agents of the invention are administered to a subject, in accord with known methods, such as intravenous administration as a bolus or by continuous infusion over a period of time, by intramuscular, intraperitoneal, intracerobrospinal, subcutaneous, intra-articular, intrasynovial, intrathecal, oral, topical, or inhalation routes. Intravenous or subcutaneous administration of the antibody is preferred.

Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

An improvement in the disease may be characterized as a complete response. By "complete response" is intended an absence of clinically detectable disease with normalization of any previously abnormal radiographic studies, bone marrow, and cerebrospinal fluid (CSF) or abnormal monoclonal protein in the case of myeloma.

Such a response may persist for at least 4 to 8 weeks, or sometimes 6 to 8 weeks, following treatment according to the methods of the invention. Alternatively, an improvement in the disease may be categorized as being a partial response. By "partial response" is intended at least about a 50% decrease in all measurable tumor burden (i.e., the number of malignant cells present in the subject, or the measured bulk of tumor masses or the quantity of abnormal monoclonal protein) in the absence of new lesions, which may persist for 4 to 8 weeks, or 6 to 8 weeks.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the bispecific antibodies used in the present invention depend on the disease or condition to be treated and may be determined by the persons skilled in the art.

An exemplary, non-limiting range for a therapeutically effective amount of an bispecific antibody used in the present invention is about 0.1-100 mg/kg, such as about 0.1-50 mg/kg, for example about 0.1-20 mg/kg, such as about 0.1-10 mg/kg, for instance about 0.5, about such as 0.3, about 1, or about 3 mg/kg. In another embodiment, the antibody is administered in a dose of 1 mg/kg or more, such as a dose of from 1 to 20 mg/kg, e.g. a dose of from 5 to 20 mg/kg, e.g. a dose of 8 mg/kg.

A medical professional having ordinary skill in the art may readily determine and prescribe the effective amount of the pharmaceutical composition required. For example, a physician or a veterinarian could start doses of the medicament employed in the pharmaceutical composition at levels lower than that required in order to achieve the desired therapeutic effect and gradually increase the dosage until the desired effect is achieved.

In one embodiment, the bispecific antibody is administered by infusion in a weekly dosage of from 10 to 500 mg/kg such as of from 200 to 400 mg/kg Such administration may be repeated, e.g., 1 to 8 times, such as 3 to 5 times. The administration may be performed by continuous infusion over a period of from 2 to 24 hours, such as of from 2 to 12 hours.

In one embodiment, the bispecific antibody is administered by slow continuous infusion over a long period, such as more than 24 hours, if required to reduce side effects including toxicity.

In one embodiment the bispecific antibody is administered in a weekly dosage of from 250 mg to 2000 mg, such as for example 300 mg, 500 mg, 700 mg, 1000 mg, 1500 mg or 2000 mg, for up to 8 times, such as from 4 to 6 times. The administration may be performed by continuous infusion over a period of from 2 to 24 hours, such as of from 2 to 12 hours. Such regimen may be repeated one or more times as necessary, for example, after 6 months or 12 months. The dosage may be determined or adjusted by measuring the amount of compound of the present invention in the blood upon administration by for instance taking out a biological sample and using anti-idiotypic antibodies which target the antigen binding region of the bispecific antibody.

In a further embodiment, the bispecific antibody is administered once weekly for 2 to 12 weeks, such as for 3 to 10 weeks, such as for 4 to 8 weeks.

In one embodiment, the bispecific antibody is administered by maintenance therapy, such as, e.g., once a week for a period of 6 months or more.

In one embodiment, the bispecific antibody is administered by a regimen including one infusion of an bispecific antibody followed by an infusion of an bispecific antibody conjugated to a radioisotope. The regimen may be repeated, e.g., 7 to 9 days later.

As non-limiting examples, treatment according to the present invention may be provided as a daily dosage of an antibody in an amount of about 0.1-100 mg/kg, such as 0.5, 0.9, 1.0, 1.1, 1.5, 2, 3, 4, 5, 6, 7, 8, 9, 10, 11, 12, 13, 14, 15, 16, 17, 18, 19, 20, 21, 22, 23, 24, 25, 26, 27, 28, 29, 30, 40, 45, 50, 60, 70, 80, 90 or 100 mg/kg, per day, on at least one of day 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40, or alternatively, at least one of week 1, 2, 3, 4, 5, 6, 7, 8, 9, 10, 11, 12, 13, 14, 15, 16, 17, 18, 19 or 20 after initiation of treatment, or any combination thereof, using single or divided doses of every 24, 12, 8, 6, 4, or 2 hours, or any combination thereof.

In some embodiments the bispecific antibody molecule thereof is used in combination with one or more additional therapeutic agents, e.g. a chemotherapeutic agent. Non-limiting examples of DNA damaging chemotherapeutic agents include topoisomerase I inhibitors (e.g., irinotecan, topotecan, camptothecin and analogs or metabolites thereof, and doxorubicin); topoisomerase II inhibitors (e.g., etoposide, teniposide, and daunorubicin); alkylating agents (e.g., melphalan, chlorambucil, busulfan, thiotepa, ifosfamide, carmustine, lomustine, semustine, streptozocin, decarbazine, methotrexate, mitomycin C, and cyclophosphamide); DNA intercalators (e.g., cisplatin, oxaliplatin, and carboplatin); DNA intercalators and free radical generators such as bleomycin; and nucleoside mimetics (e.g., 5-fluorouracil, capecitibine, gemcitabine, fludarabine, cytarabine, mercaptopurine, thioguanine, pentostatin, and hydroxyurea).

Chemotherapeutic agents that disrupt cell replication include: paclitaxel, docetaxel, and related analogs; vincristine, vinblastin, and related analogs; thalidomide, lenalidomide, and related analogs (e.g., CC-5013 and CC-4047); protein tyrosine kinase inhibitors (e.g., imatinib mesylate and gefitinib); proteasome inhibitors (e.g., bortezomib); NF-κB inhibitors, including inhibitors of IκB kinase; antibodies which bind to proteins overexpressed in cancers and thereby downregulate cell replication (e.g., trastuzumab, rituximab, cetuximab, and bevacizumab); and other inhibitors of proteins or enzymes known to be upregulated, over-expressed or activated in cancers, the inhibition of which downregulates cell replication.

In some embodiments, the antibodies of the invention can be used prior to, concurrent with, or after treatment with Velcade® (bortezomib).

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et at, 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein.

EXAMPLES

Example 1

Alternate Formats

Bispecifics Production

Figure 35:
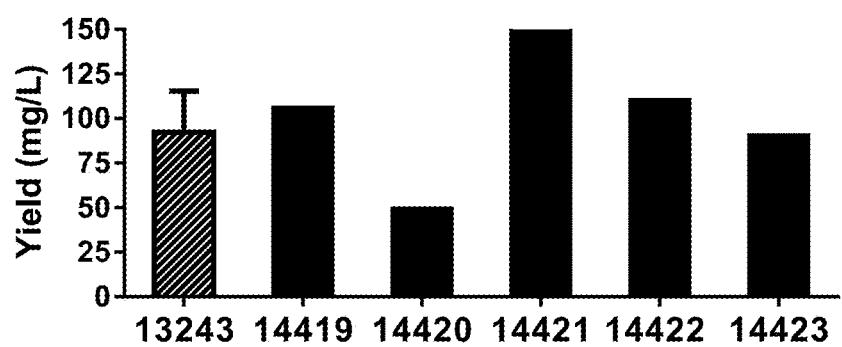
FIG. 35 Expression yields of bispecifics after protein A affinity purification.
Figure 36:
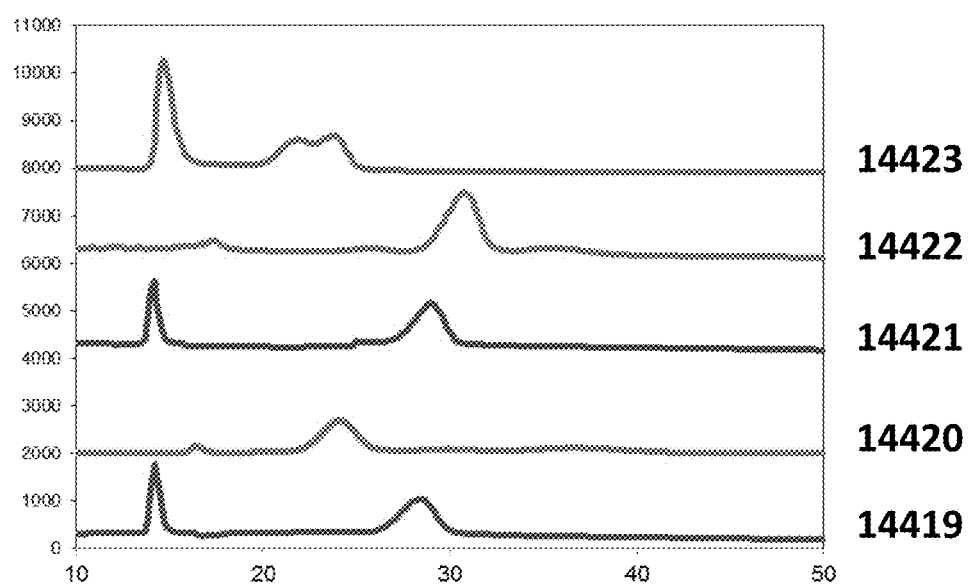
FIG. 36 Cationic exchange purification chromatograms.

Cartoon schematics of anti-CD38×anti-CD3 bispecifics are shown in FIG. 1. Amino acid sequences for alternate format anti-CD38×anti-CD3 bispecifics are listed in FIG. 39 to FIG. 43. DNA encoding the three chains needed for bispecific expression were generated by gene synthesis (Blue Heron Biotechnology, Bothell, Wash.) and were subcloned using standard molecular biology techniques into the expression vector pTT5. Substitutions were introduced using either site-directed mutagenesis (QuikChange, Stratagene, Cedar Creek, Tex.) or additional gene synthesis and subcloning. DNA was transfected into HEK293E cells for expression and resulting proteins were purified from the supernatant using protein A affinity (GE Healthcare) and cation exchange chromatography. Yields following protein A affinity purification are shown in FIG. 35. Cation exchange chromatography purification was performed using a HiTrap SP HP column (GE Healthcare) with a wash/equilibration buffer of 50 mM MES, pH 6.0 and an elution buffer of 50 mM MES, pH 6.0+1 M NaCl linear gradient (see FIG. 36 for chromatograms).

Redirected T Cell Cytotoxicity

Anti-CD38×anti-CD3 bispecifics were characterized in vitro for redirected T cell cytotoxicity (RTCC) of the CD38+ RPMI8266 myeloma cell line. 10k RPMI8266 cells were incubated for 24 h with 500k human PBMCs. RTCC was measured by LDH fluorescence as indicated (see FIG. 37).

Example 2

Redirected T Cell Cytotoxicity

Figure 44:
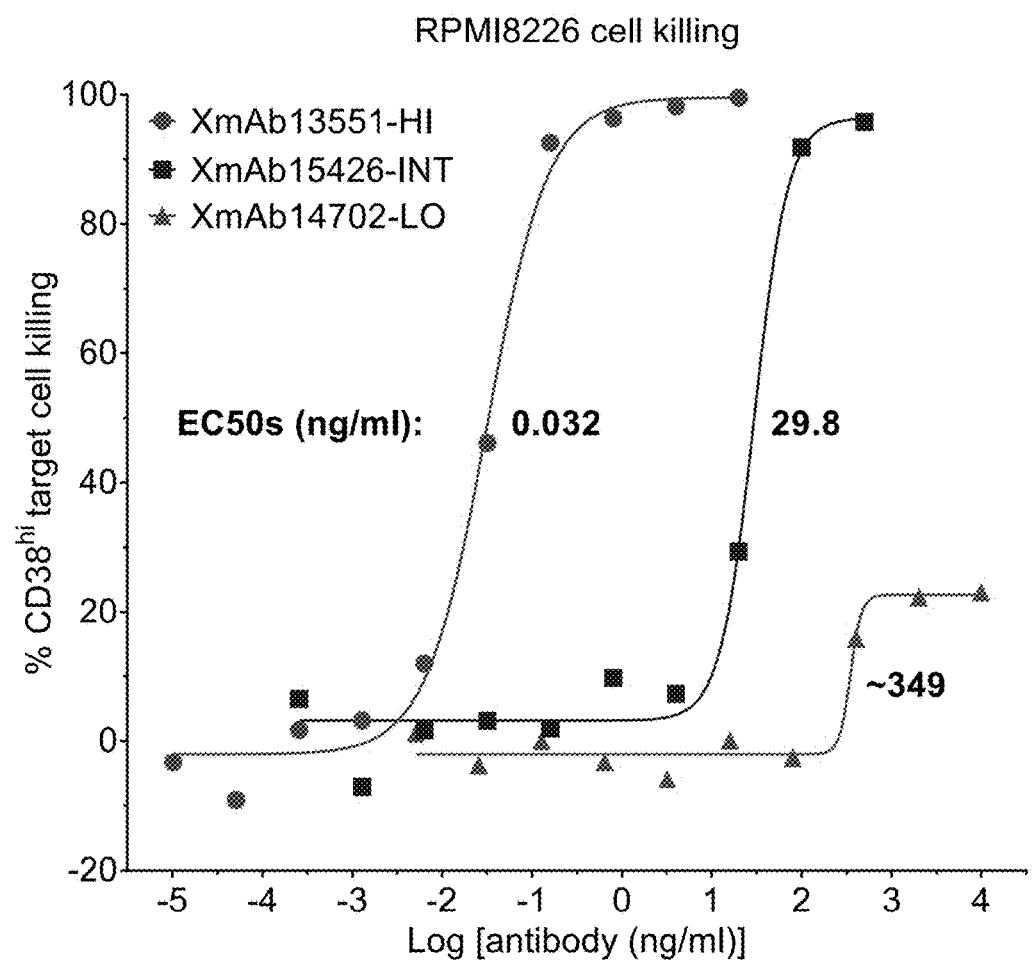
FIG. 44 Redirected T cell cytotoxicity assay, 96 h incubation, 40k RPMI8226 cells, 400k human PBMC. Test articles are anti-CD38×anti-CD3 Fab-scFv-Fcs. Detection was by flow cytometry, specifically the disappearance of CD38+ cells.
Figure 45:
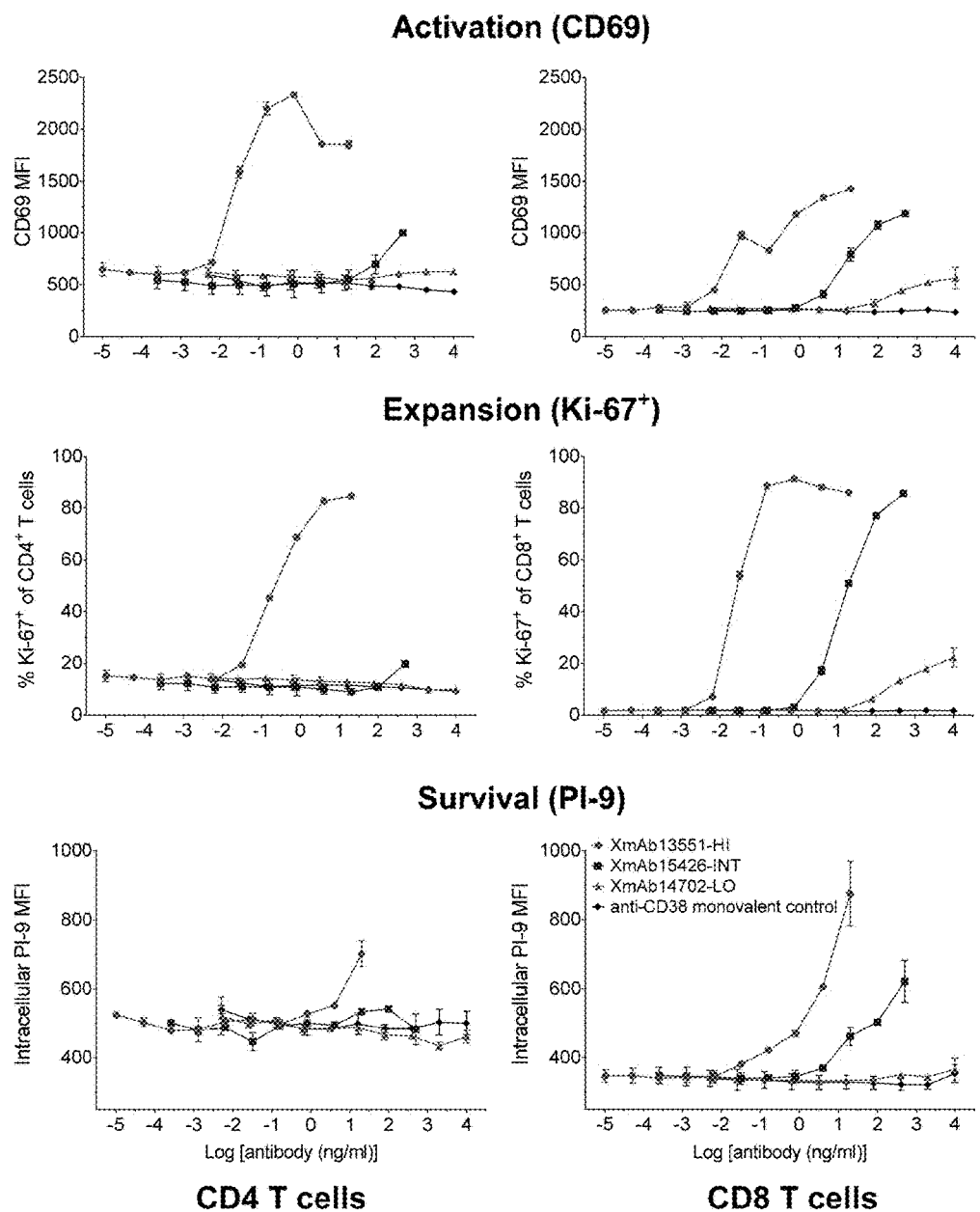
FIG. 45 Further analysis of redirected T cell cytotoxicity assay described in FIG. 1. The first row shows the Mean Fluorescence Intensity (MFI) of activation marker CD69 on CD4+ and CD8+ T cells as detected by flow cytometry. The second row shows the percentage of CD4+ and CD8+ T cells that are Ki-67+, a measure of cell proliferation. The third row shows the intracellular Mean Fluorescence Intensity (MFI) of granzyme B inhibitor PI-9 on CD4+ and CD8+ T cells as detected by flow cytometry.

Anti-CD38×anti-CD3 Fab-scFv-Fc bispecifics were characterized in vitro for redirected T cell cytotoxicity (RTCC) of the CD38+ RPMI8266 myeloma cell line. 40k RPMI8266 cells were incubated for 96 h with 400k human PBMCs. RTCC was measured by flow cytometry as indicated (see FIG. 44). CD4+ and CD8+ T cell expression of CD69, Ki-67, and PI-9 were also characterized by flow cytometry and are shown in FIG. 45.

Mouse Model of Anti-Tumor Activity

Figure 46:
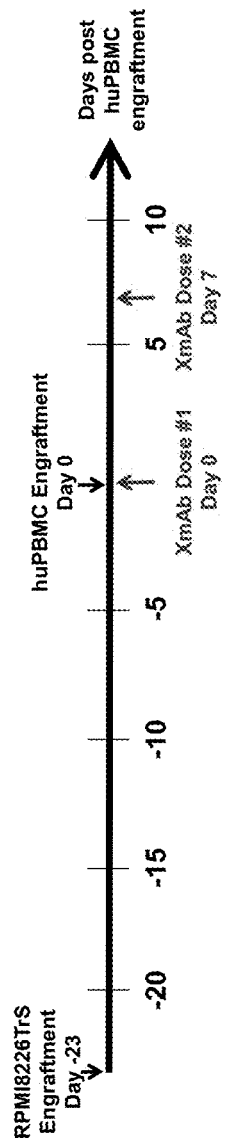
FIG. 46 Design of mouse study to examine anti-tumor activity of anti-CD38×anti-CD3 Fab-scFv-Fc bispecifics.
Figure 47:
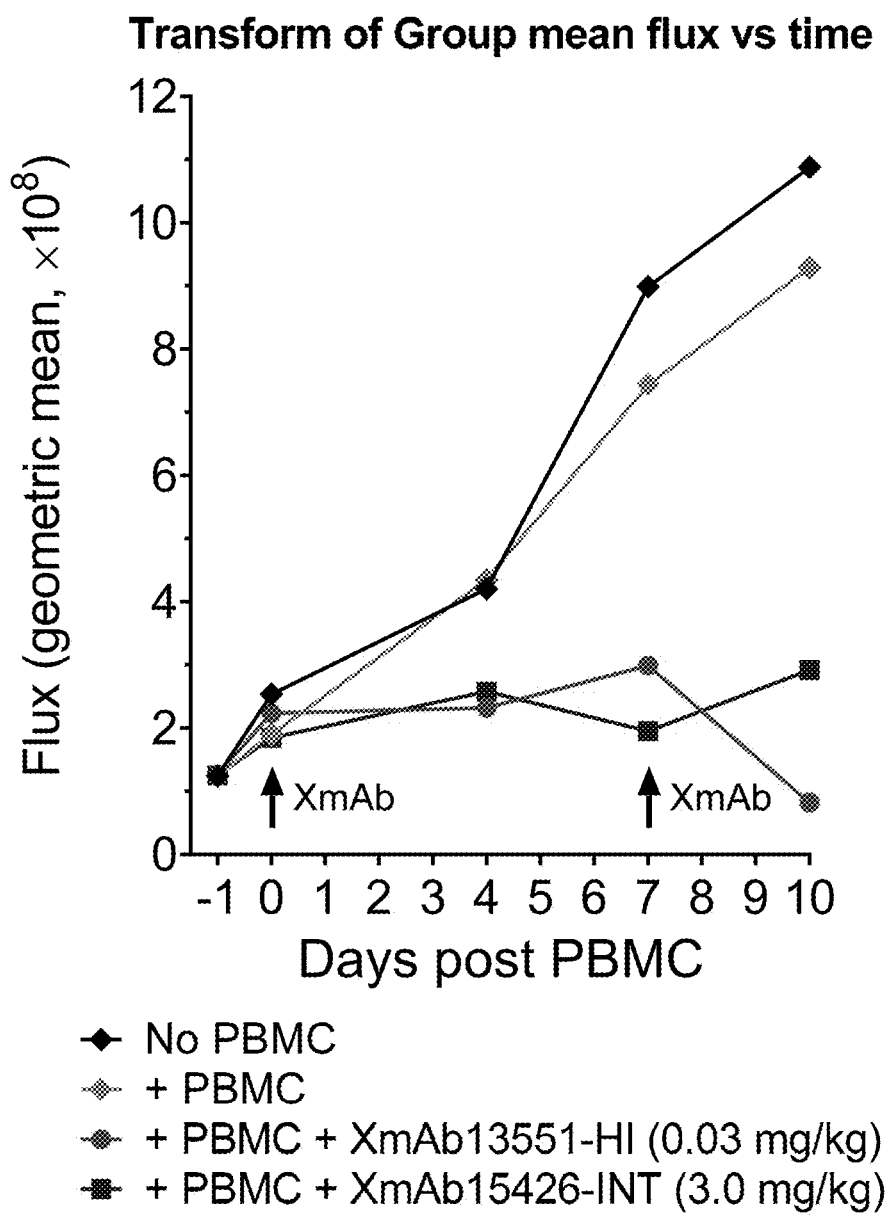
FIG. 47 Tumor size measured by IVIS® as a function of time and treatment
Figure 48:
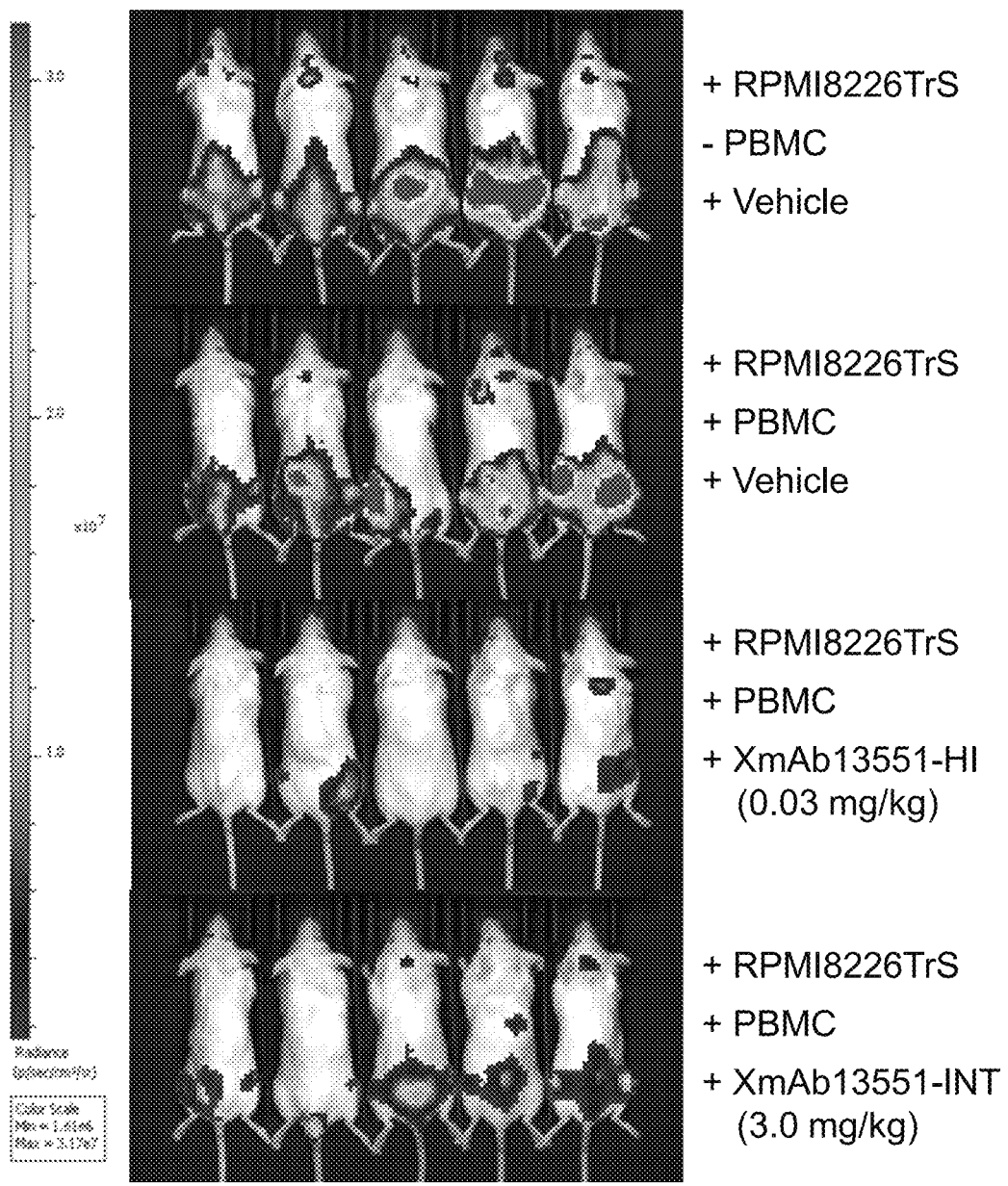
FIG. 48 IVIS® bioluminescent images (Day 10)

Four groups of five NOD scid gamma (NSG) mice each were engrafted with 5×106 RPMI8226TrS tumor cells (multiple myeloma, luciferase-expressing) by intravenous tail vein injection on Day −23. On Day 0, mice were engrafted intraperitoneally with 10×106 human PBMCs. After PBMC engraftment on Day 0, test articles are dosed weekly (Days 0, 7) by intraperitoneal injection at dose levels indicated in FIG. 4. Study design is further summarized in FIG. 46. Tumor growth was monitored by measuring total flux per mouse using an in vivo imaging system (IVIS®). Both XmAb13551 and XmAb15426 showed substantial anti-tumor effects (see FIG. 47 and FIG. 48).

Studies in Cynomolgus Monkey

Figure 49:
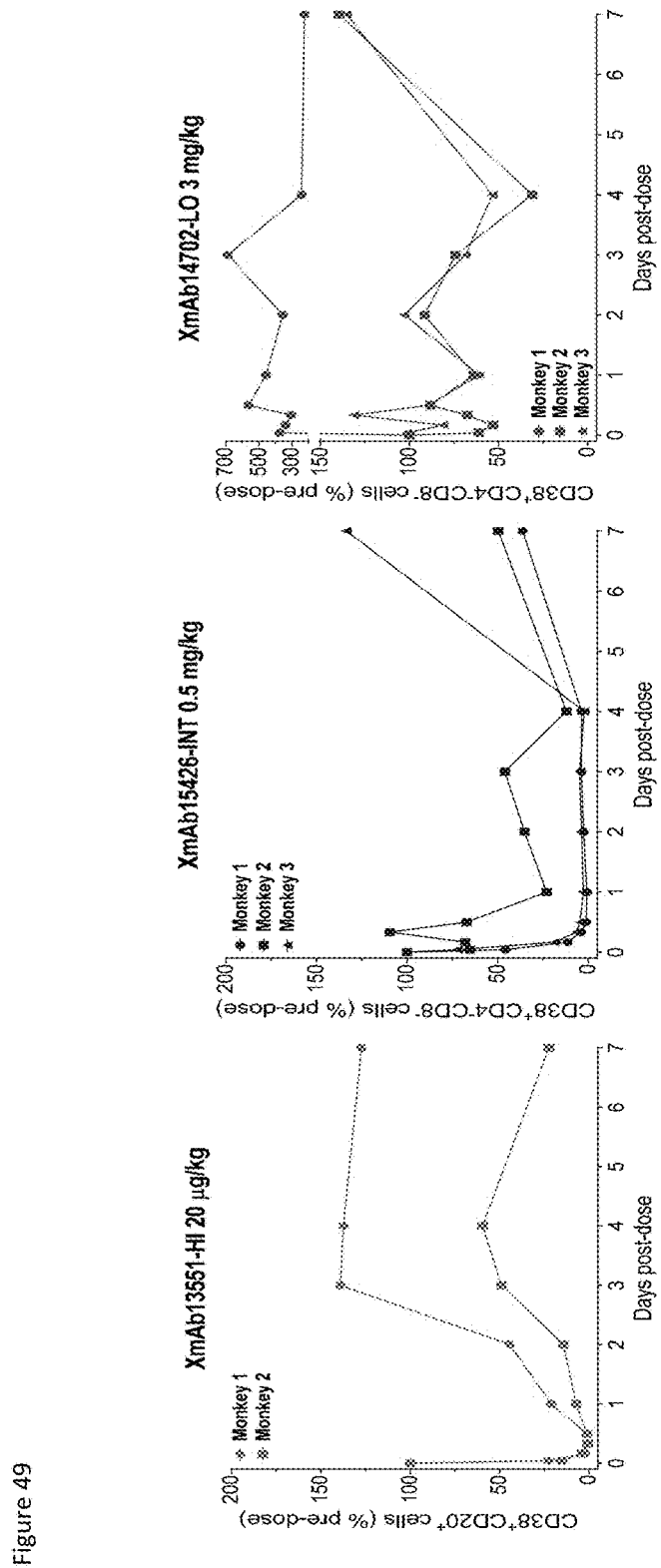
FIG. 49 Depletion of CD38+ cells in cynomolgus monkeys following single doses of the indicated test articles FIG. 50 T cell activation measured by CD69 Mean Fluorescence Intensity (MFI) in cynomolgus monkeys, color coding as in FIG. 49.
Figure 50:
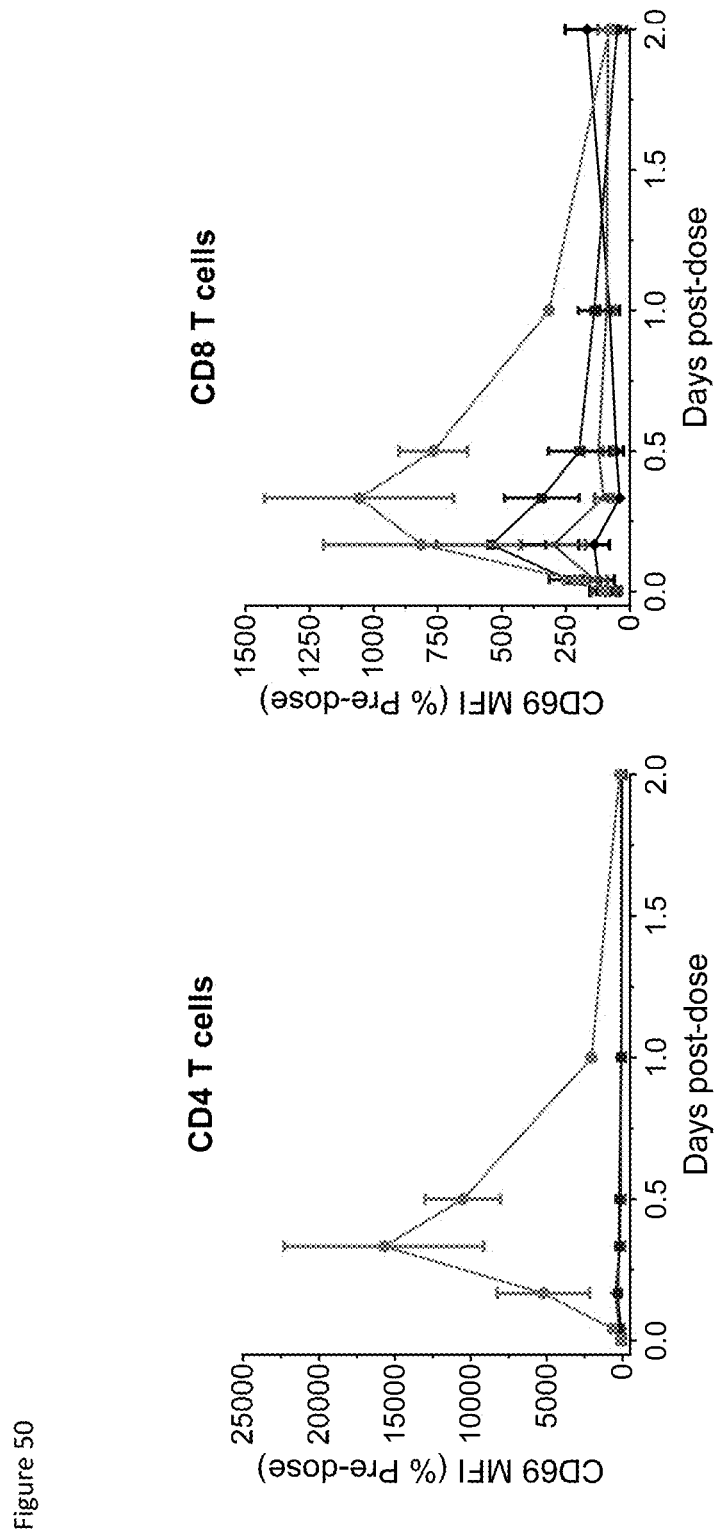
Figure 51:
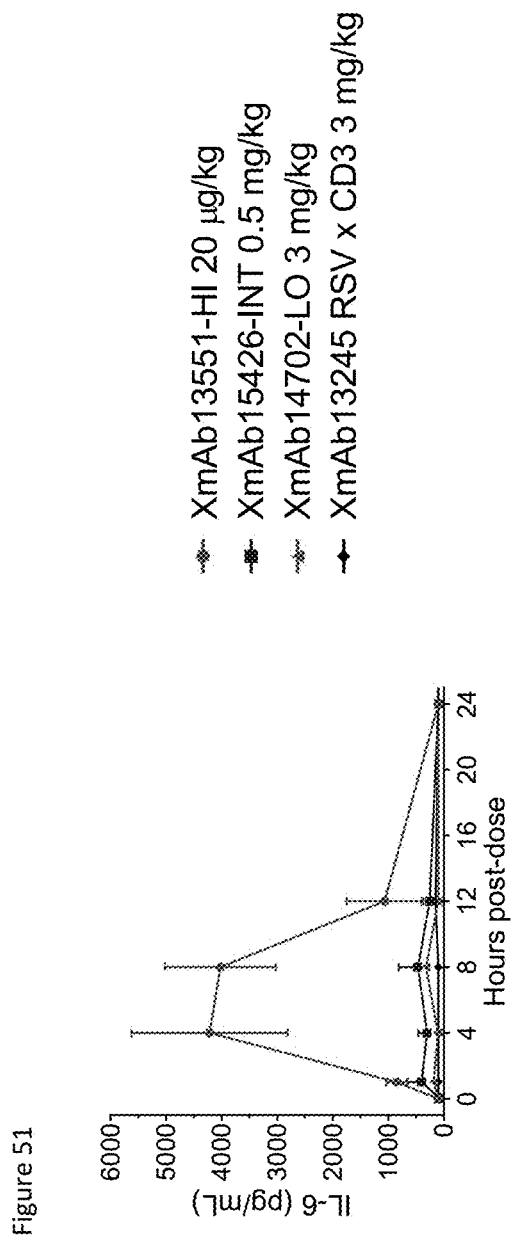
FIG. 51 Serum levels of IL-6, following single doses of the indicated test articles.
Figure 66:
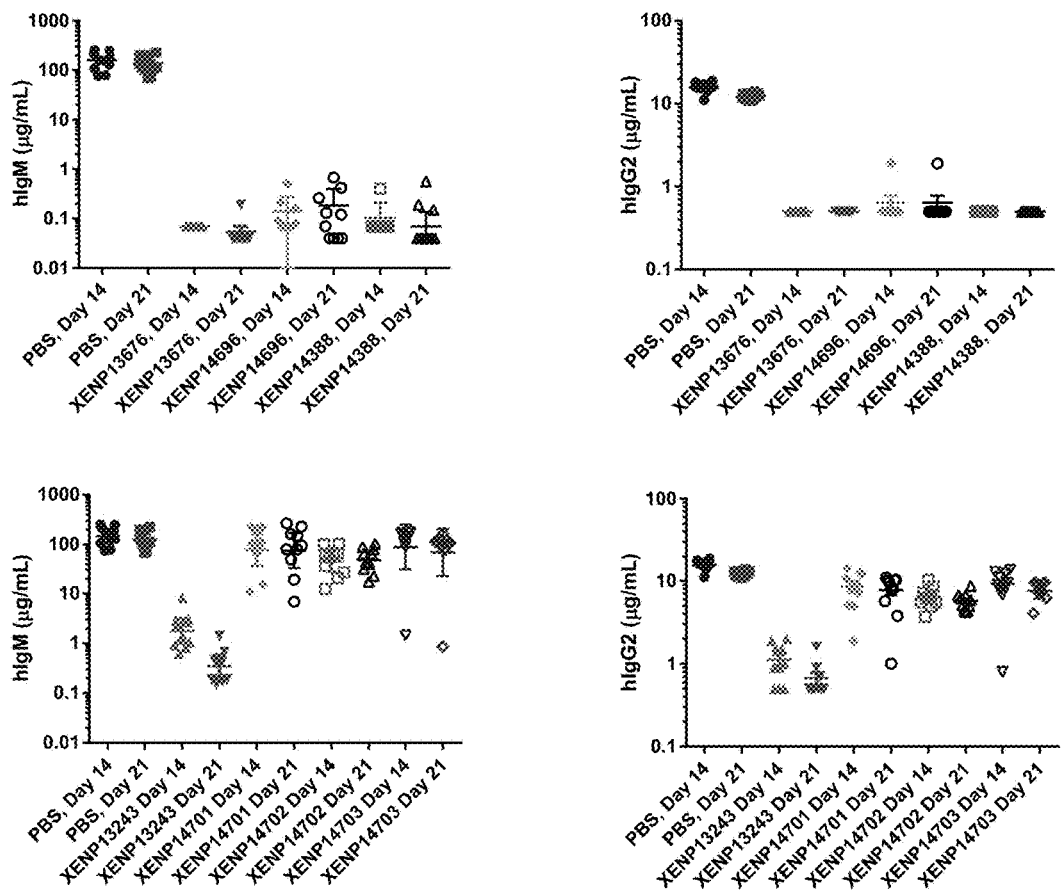
FIG. 66 Human IgM and IgG2 depletion by anti-CD38×anti-CD3 bispecifics in a huPBMC mouse model.
Figure 70:
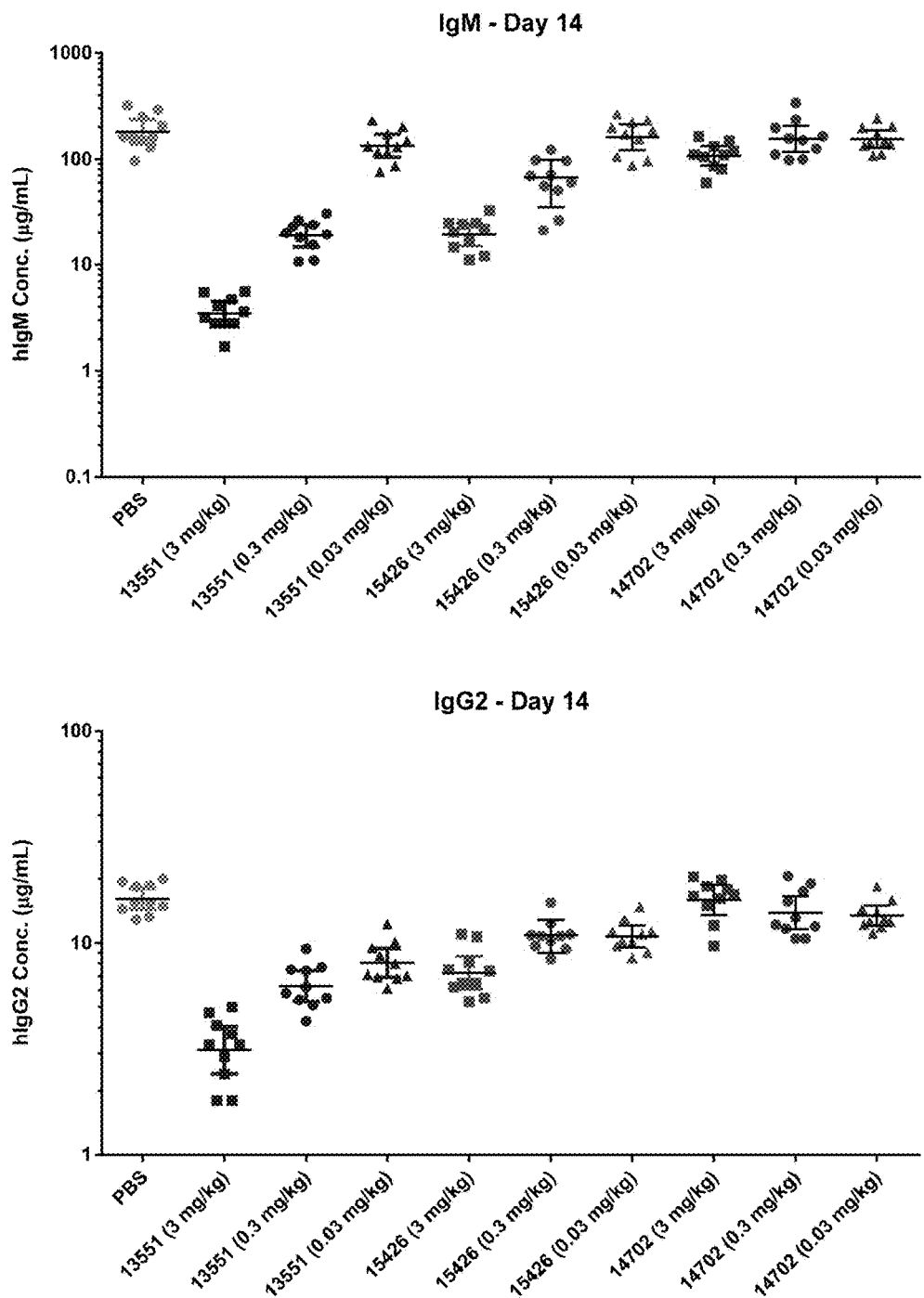
FIG. 70 huPBL-SCID Ig-depletion study. Test articles were dosed 8 d after PBMC engraftment at 0.03, 0.3, or 3 mg/kg. Route of administration was intraperitoneal. Blood samples were taken 14 d after PBMC engraftment, processed to serum, and assayed for human IgM and IgG2.
Figure 107:
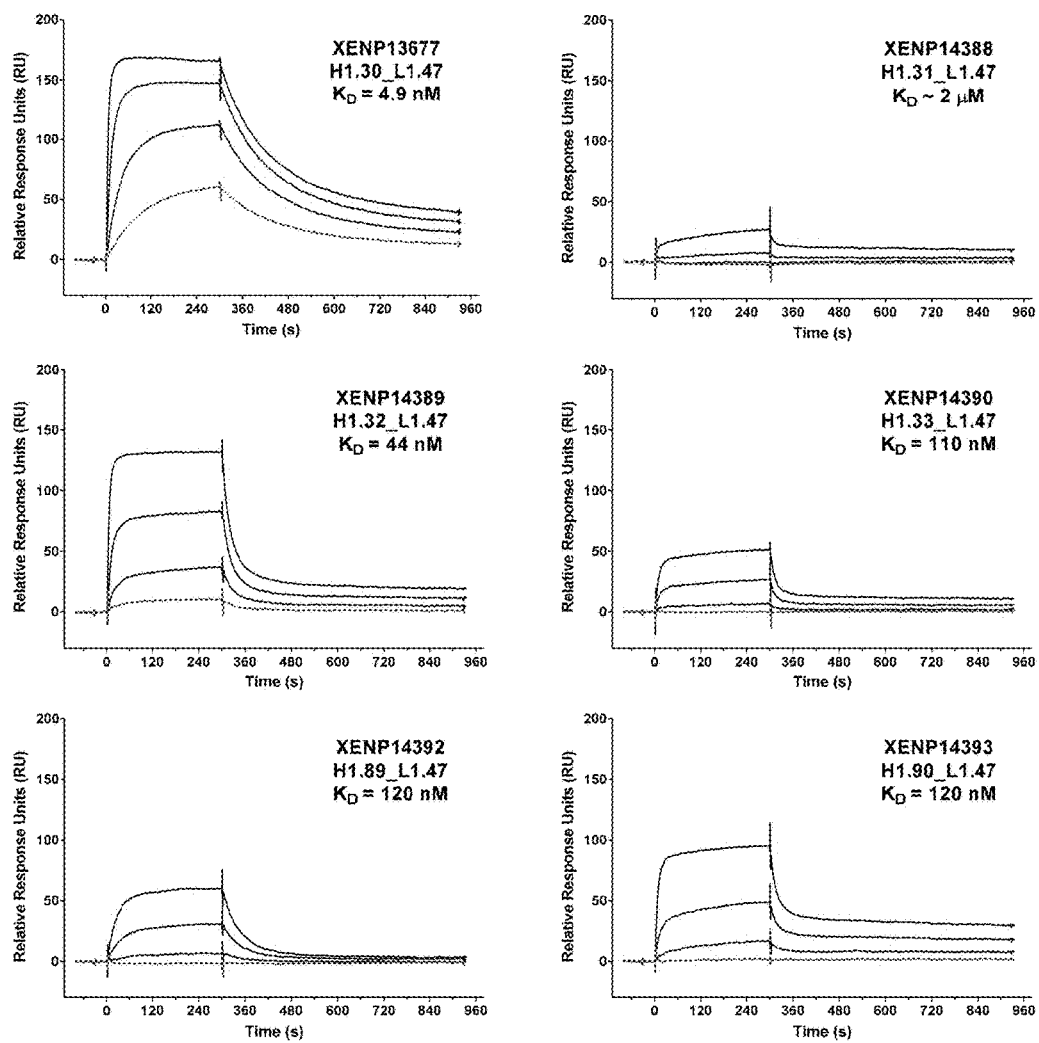
FIG. 107 Surface plasmon resonance determination of CD3 affinity. Test articles are anti-CD20 (C2B8_H1.202_L1.113)×anti-CD3 Fab-scFv-Fcs. Human CD3δε-Fc (Sino Biological) was covalently bound to the chip surface. Test articles were passed over at 3.125, 12.5, 50, and 200 nM.
Figure 108:
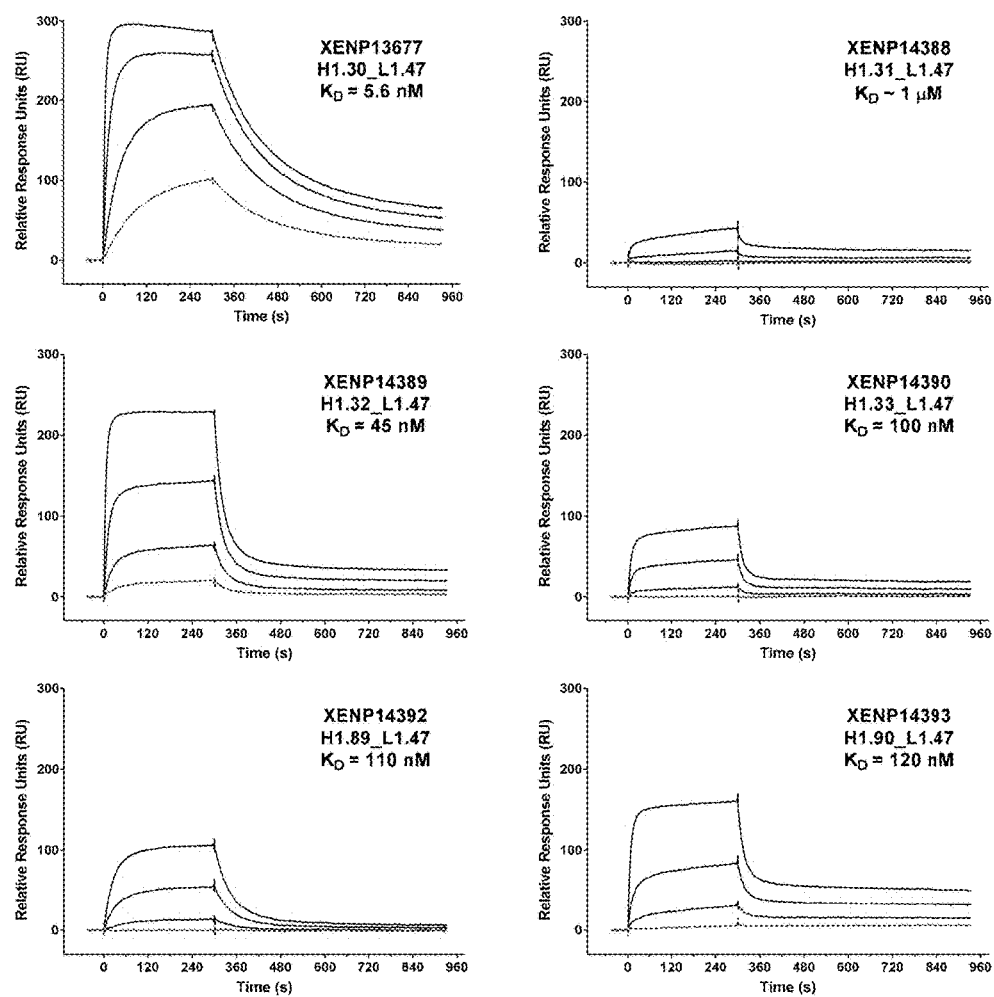
FIG. 108 Surface plasmon resonance determination of CD3 affinity. Test articles are anti-CD20 (C2B8_H1.202_L1.113)×anti-CD3 Fab-scFv-Fcs. Cynomolgus monkey CD3δε-Fc (Sino Biological) was covalently bound to the chip surface. Test articles were passed over at 3.125, 12.5, 50, and 200 nM.
Figure 109:
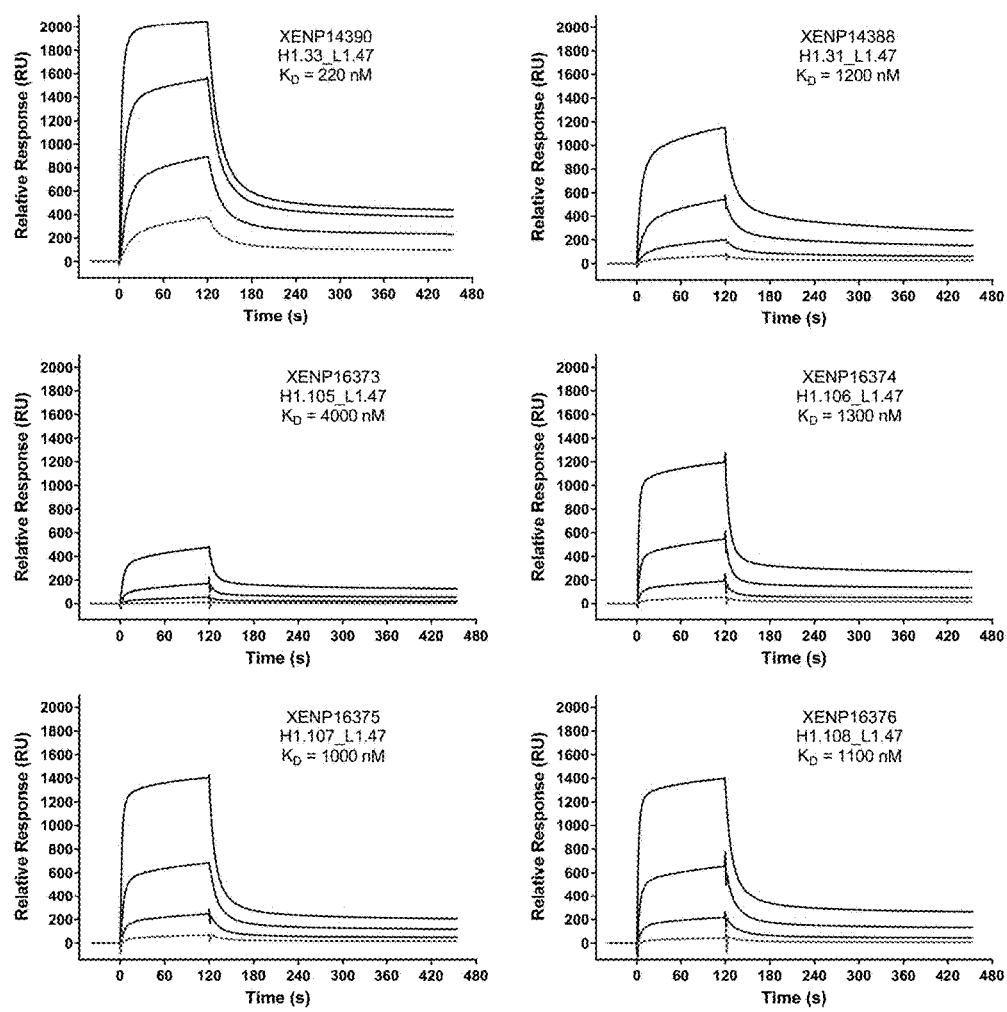
FIG. 109 Surface plasmon resonance determination of CD3 affinity. Test articles are anti-CD20 (C2B8_H1.202_L1.113)×anti-CD3 Fab-scFv-Fcs. Human CD3δε-Fc (Sino Biological) was covalently bound to the chip surface. Test articles were passed over at 31.25, 125, 500, and 2000 nM.
Figure 110:
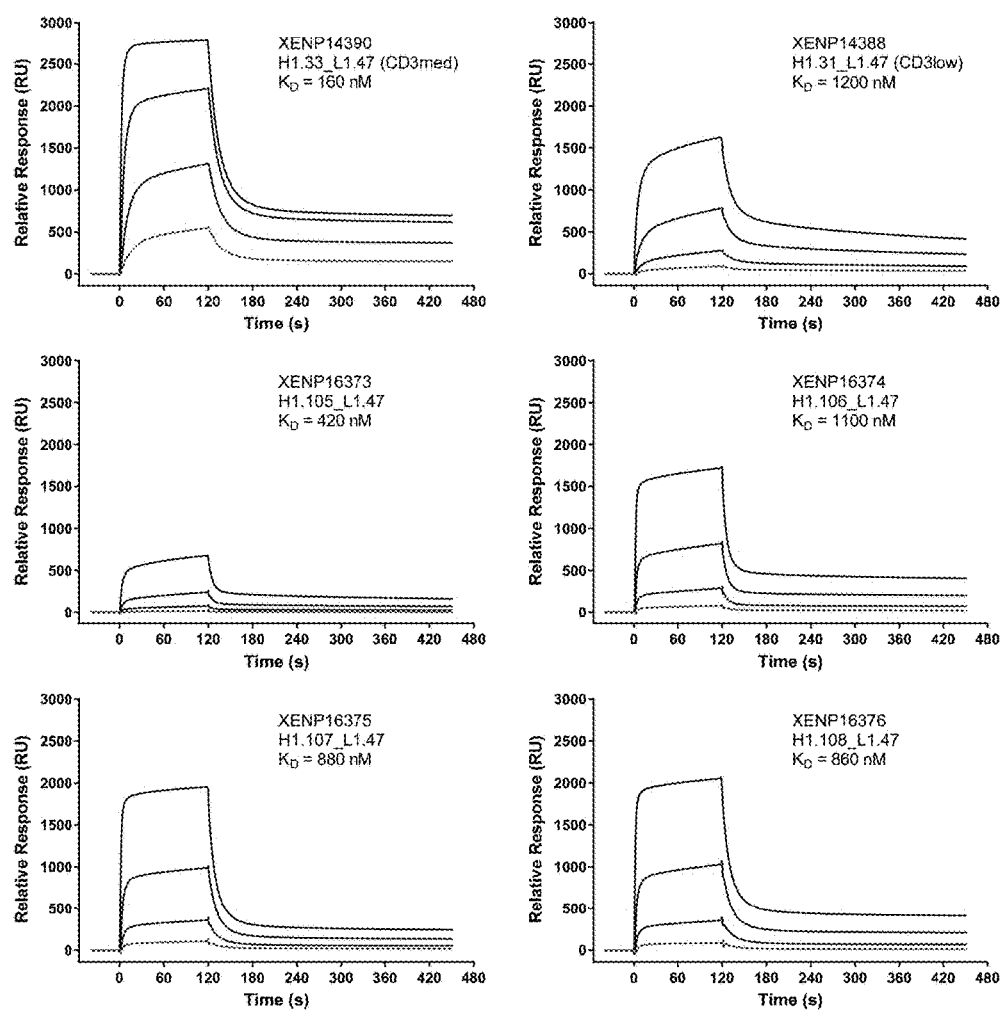
FIG. 110 Surface plasmon resonance determination of CD3 affinity. Test articles are anti-CD20 (C2B8_H1.202_L1.113)×anti-CD3 Fab-scFv-Fcs. Cynomolgus monkey CD3δε-Fc (Sino Biological) was covalently bound to the chip surface. Test articles were passed over at 31.25, 125, 500, and 2000 nM.
Figure 113:
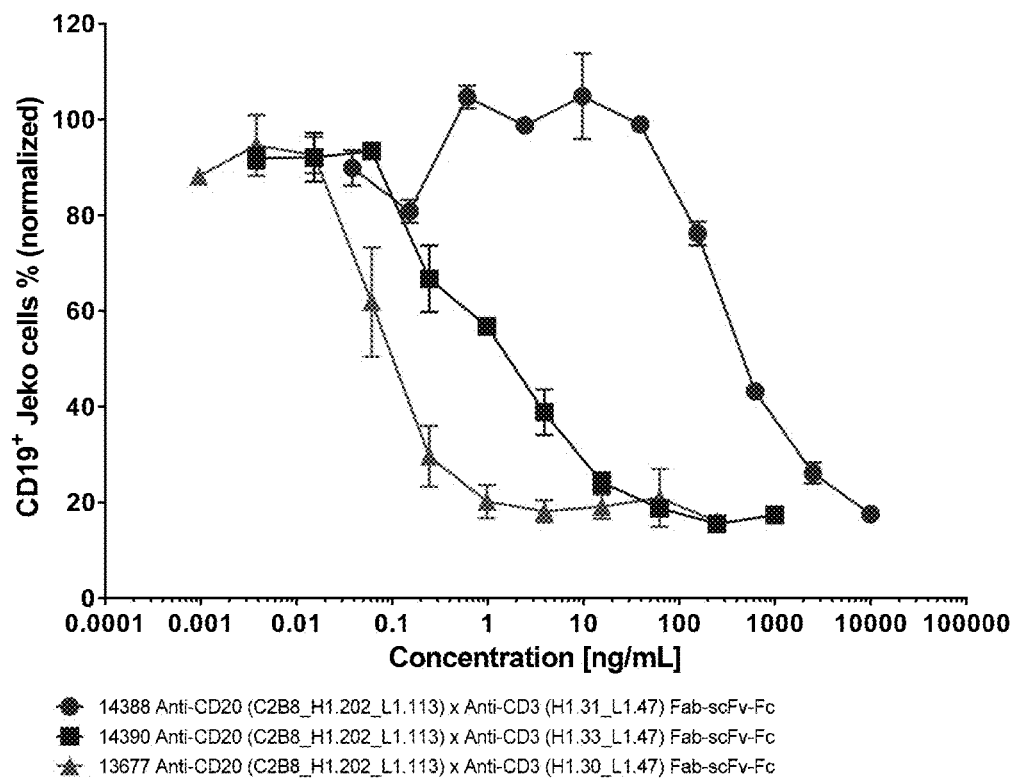
FIG. 113 Redirected T cell cytotoxicity assay, 24 h incubation, 20k Jeko cells, 200k PBMC (CD19-depleted). Test articles are anti-CD20 (C2B8_H1.202_L1.113)×anti-CD3 Fab-scFv-Fcs. Detection was by flow cytometry, specifically the disappearance of CD19$^+$ cells.
Figure 114:
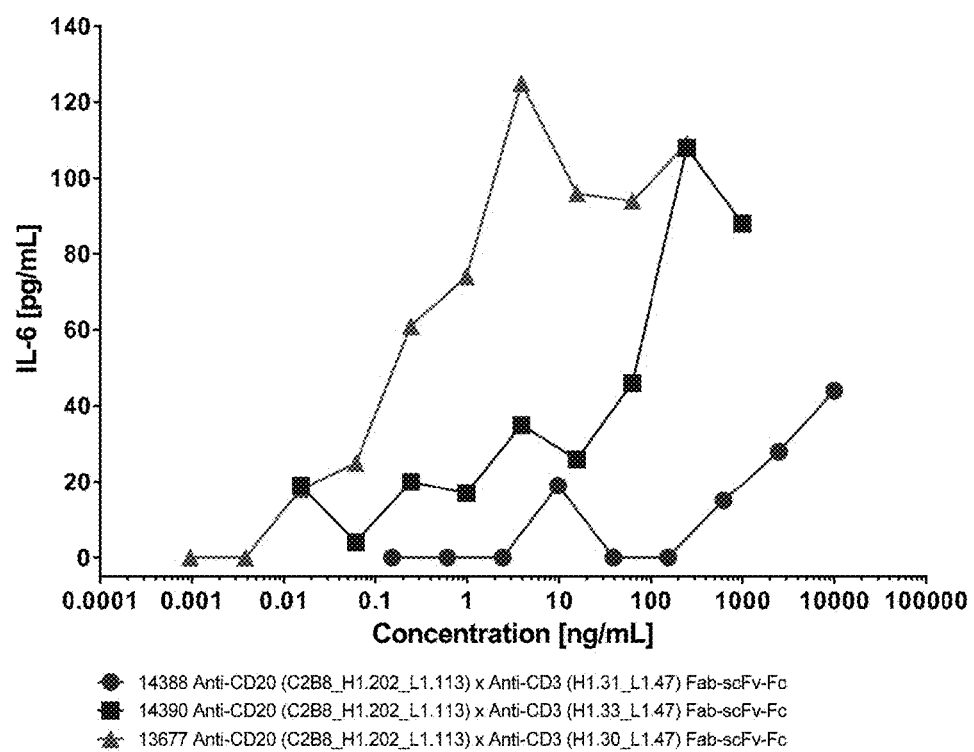
FIG. 114 IL-6 production after 24 h for the experiment described in FIG. 113.
Figure 115B:
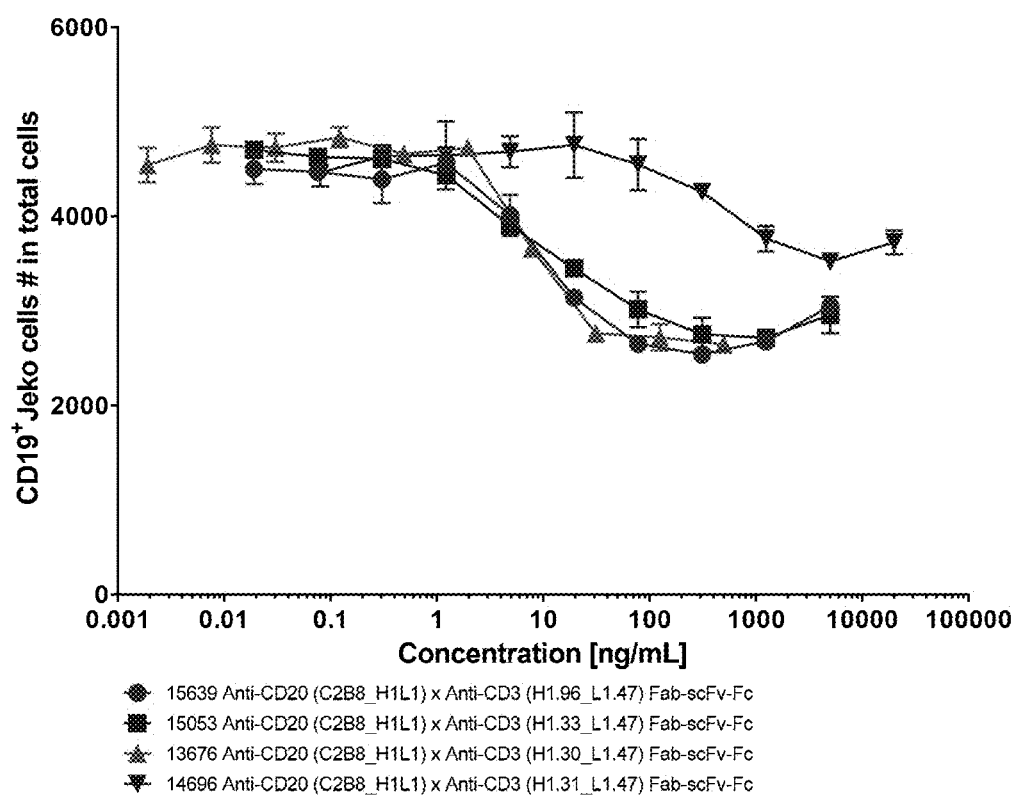
Figure 119:
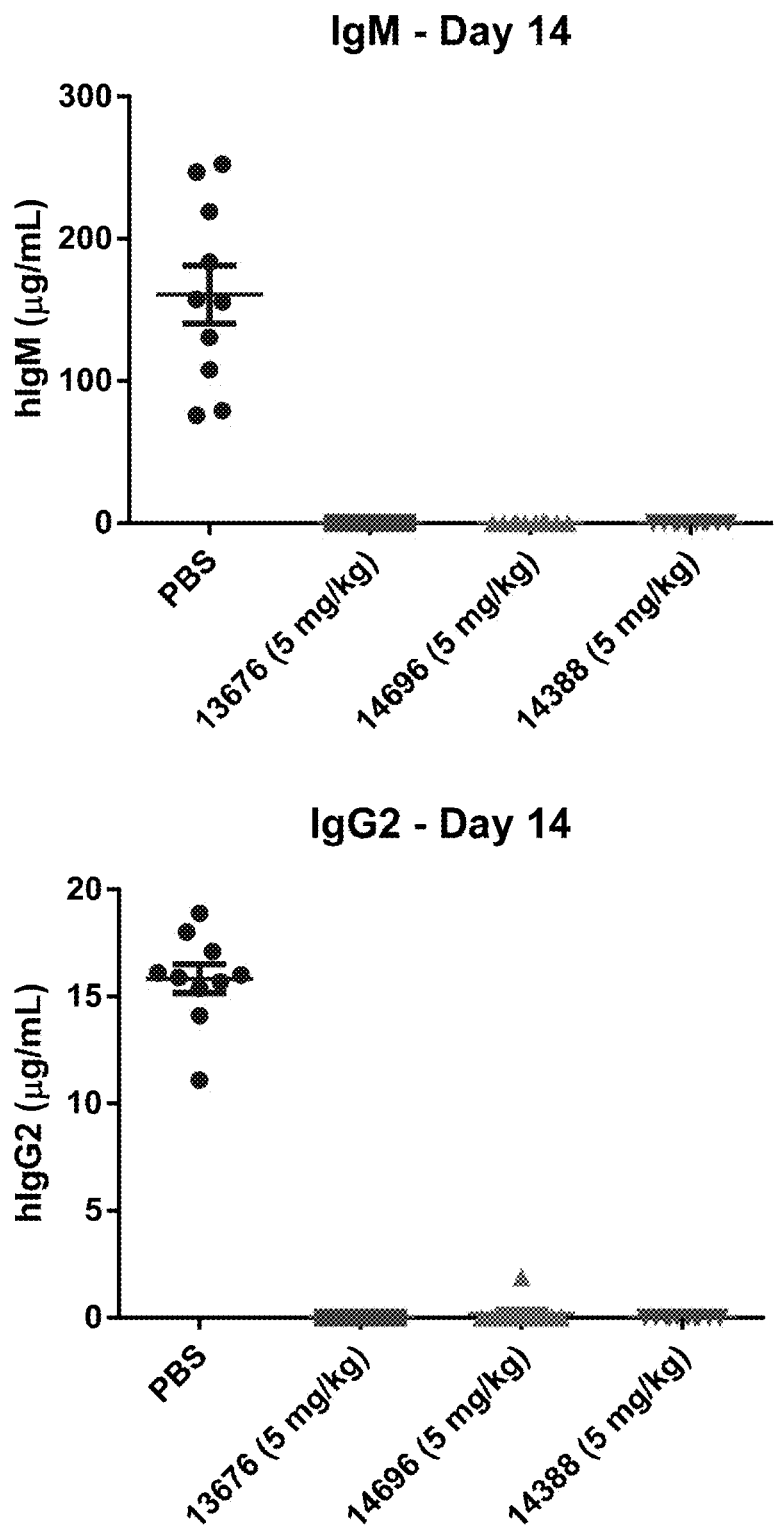
FIG. 119 huPBL-SCID Ig-depletion study. Test articles were dosed 1 and 8 d after PBMC engraftment at 5 mg/kg. Route of administration was intraperitoneal. Blood samples were taken 14 d after PBMC engraftment, processed to serum, and assayed for human IgM and IgG2.
Figure 120:
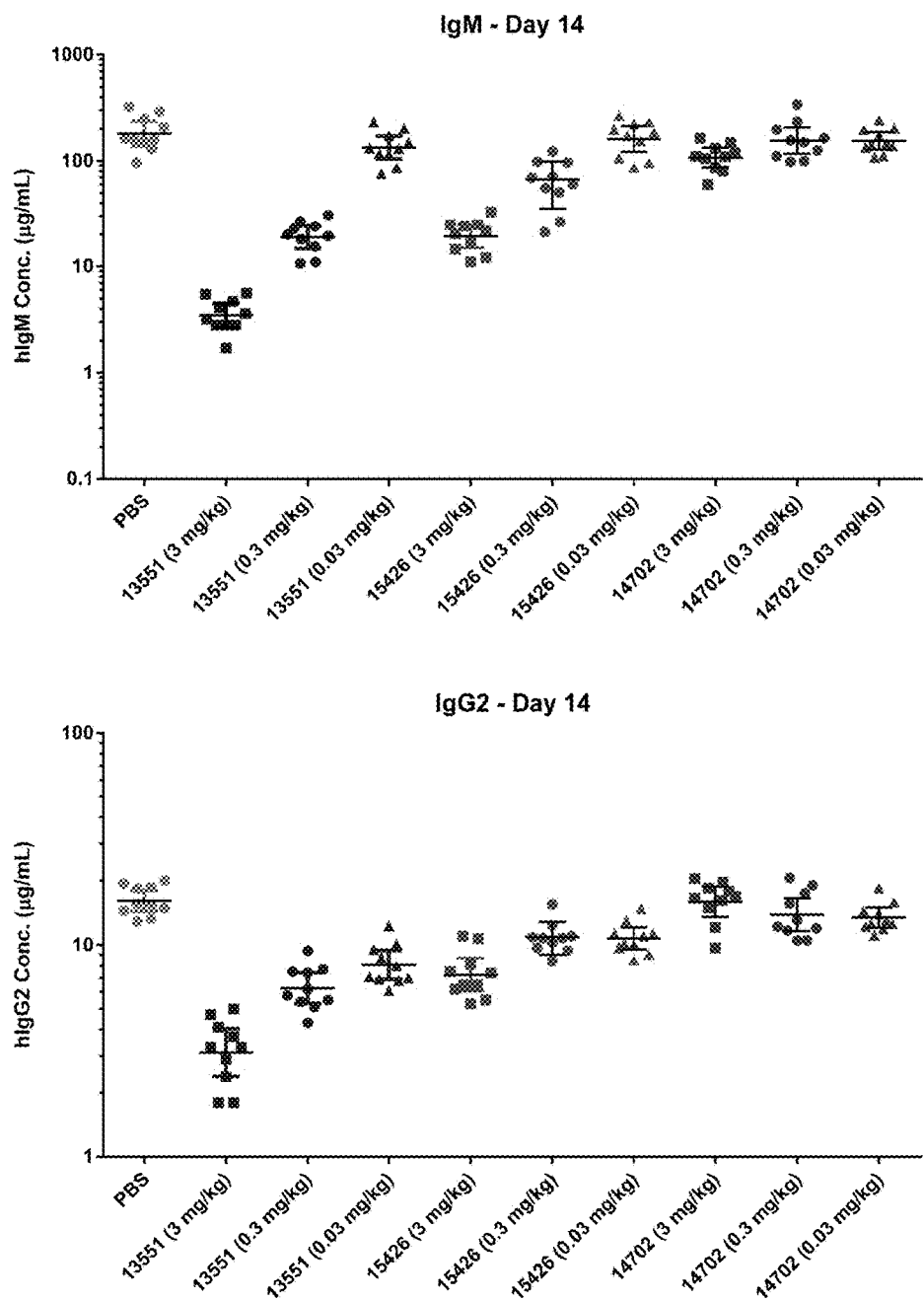
FIG. 120 huPBL-SCID Ig-depletion study. Test articles were dosed 8 d after PBMC engraftment at 0.03, 0.3, or 3 mg/kg. Route of administration was intraperitoneal. Blood samples were taken 14 d after PBMC engraftment, processed to serum, and assayed for human IgM and IgG2.
Figure 125:
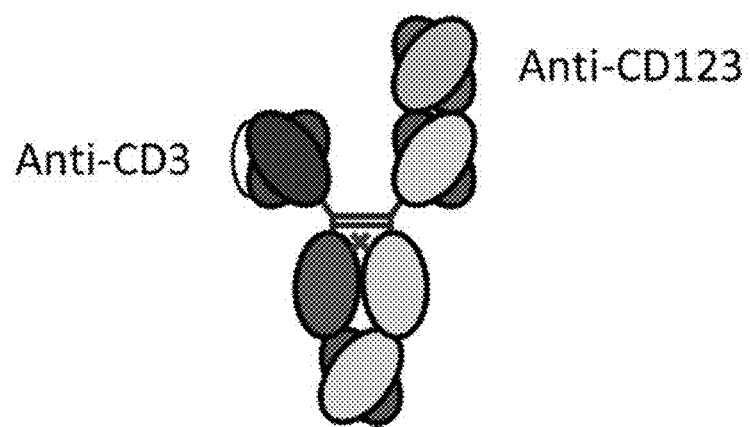
FIG. 125. Schematic of anti-CD123×anti-CD3 Fab-scFv-Fc bispecific.
Figure 128:
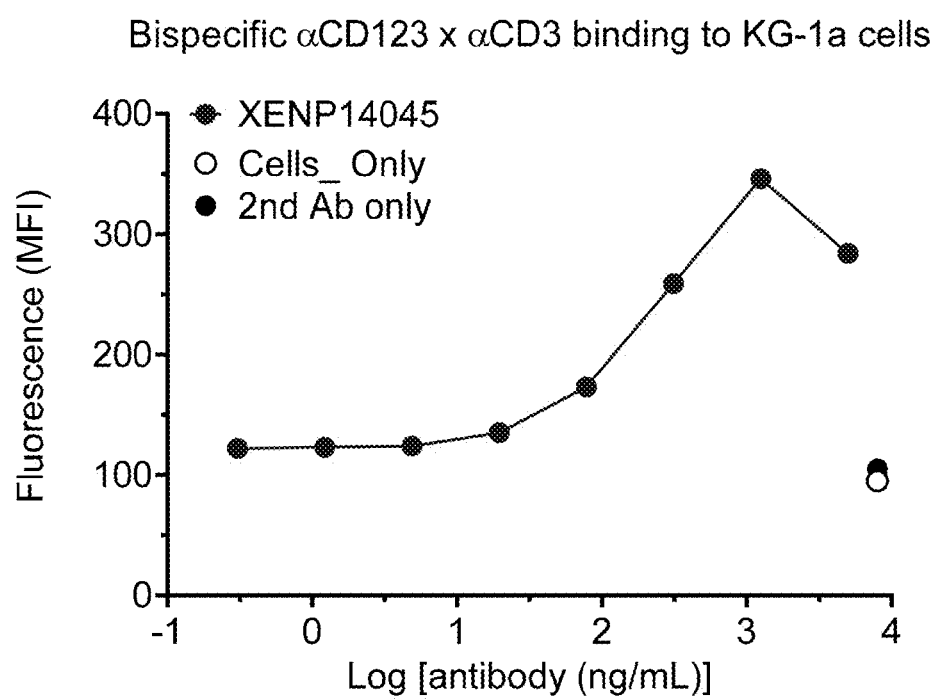
Figure 129:
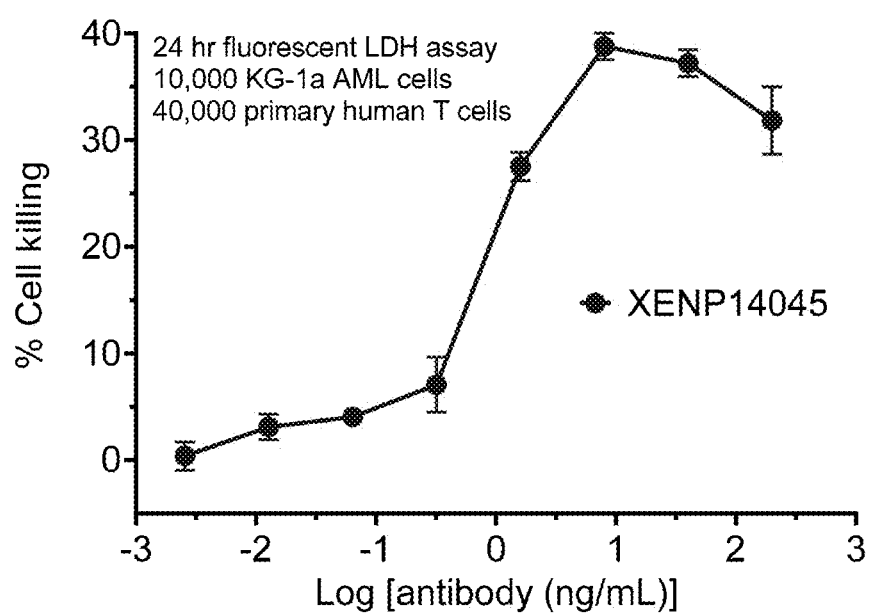
FIG. 129. Redirected T cell cytotoxicity (RTCC) of XENP14045 killing KG-1a cells.
Figure 131:
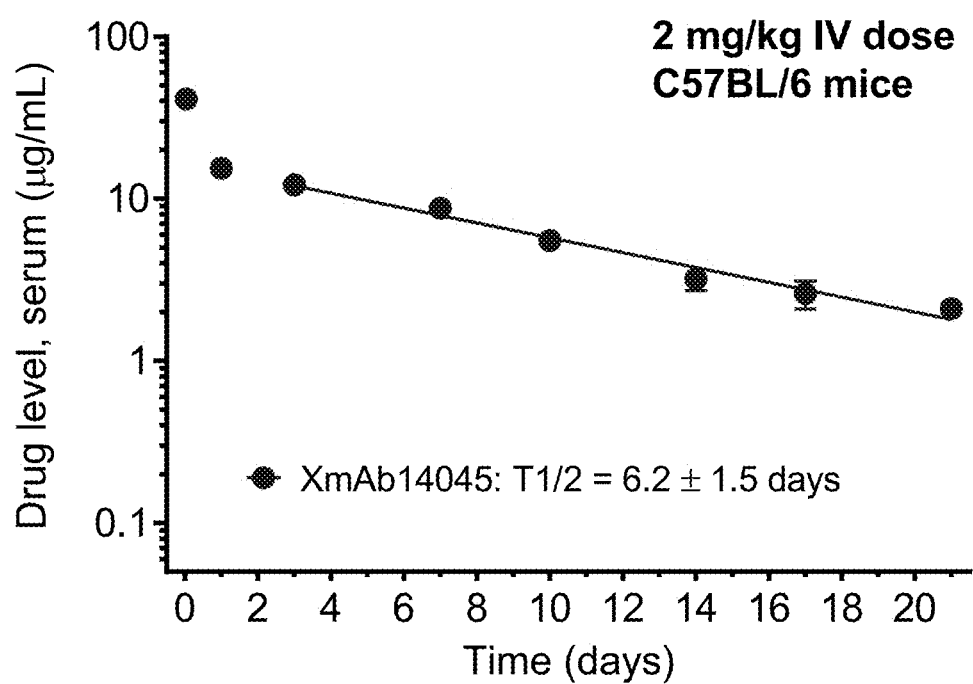
FIG. 131. Drug serum levels of 2 mg/kg XENP14045 given IV to C57BL/6 mice. The half-life of bispecific was 6.2 days.
Figure 132:
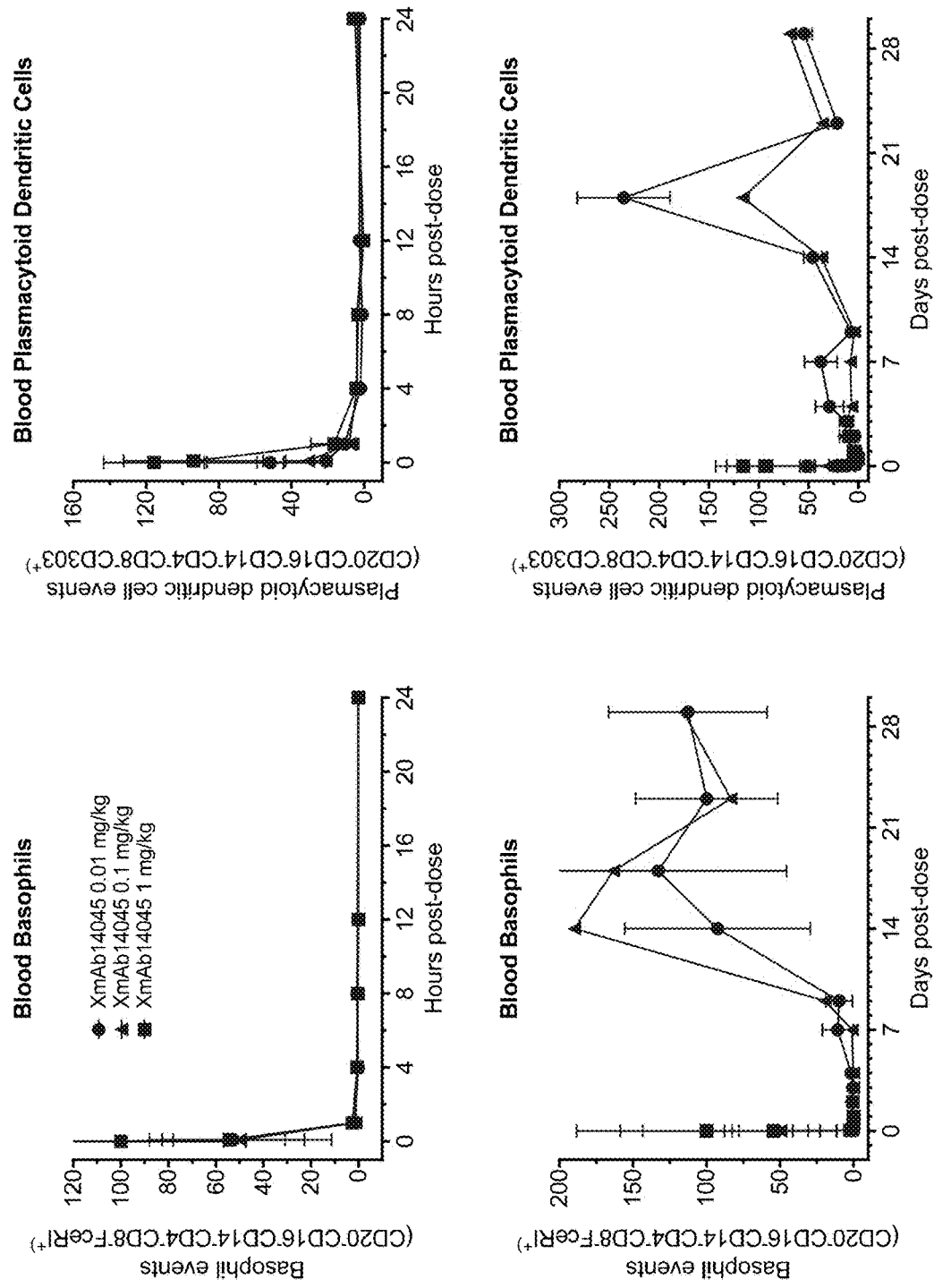
FIG. 132. Killing of CD123+ blood basophils and plasmacytoid dendritic cells (PDCs) in cynomolgus monkeys given a single IV dose of 0.01, 0.1, or 1 mg/kg XENP14045.
Figure 133:
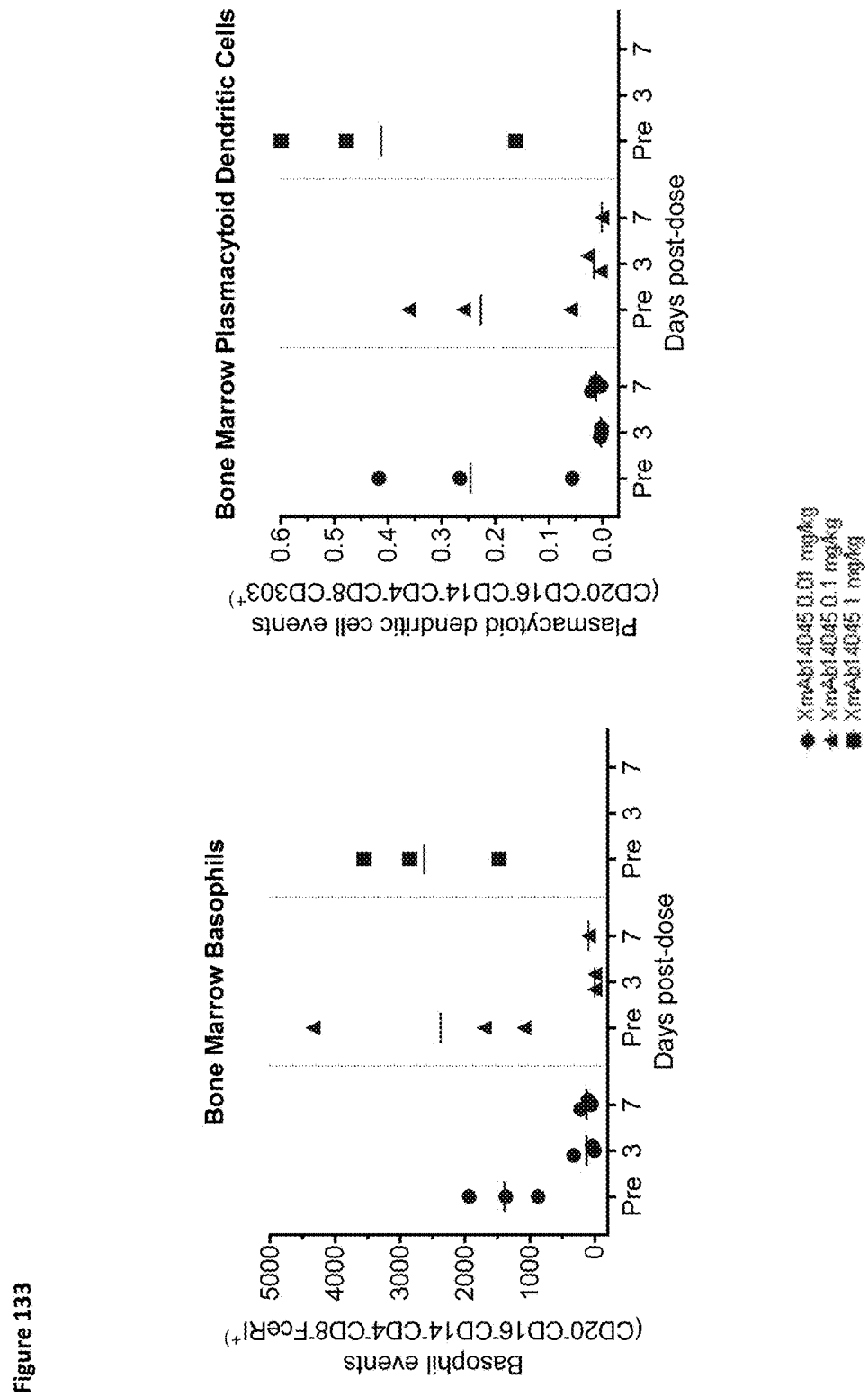
FIG. 133. Killing of CD123+ basophils and plasmacytoid dendritic cells (PDCs) in the bone marrow of cynomolgus monkeys given a single IV dose of 0.01, 0.1, or 1 mg/kg XENP14045.
Figure 134:
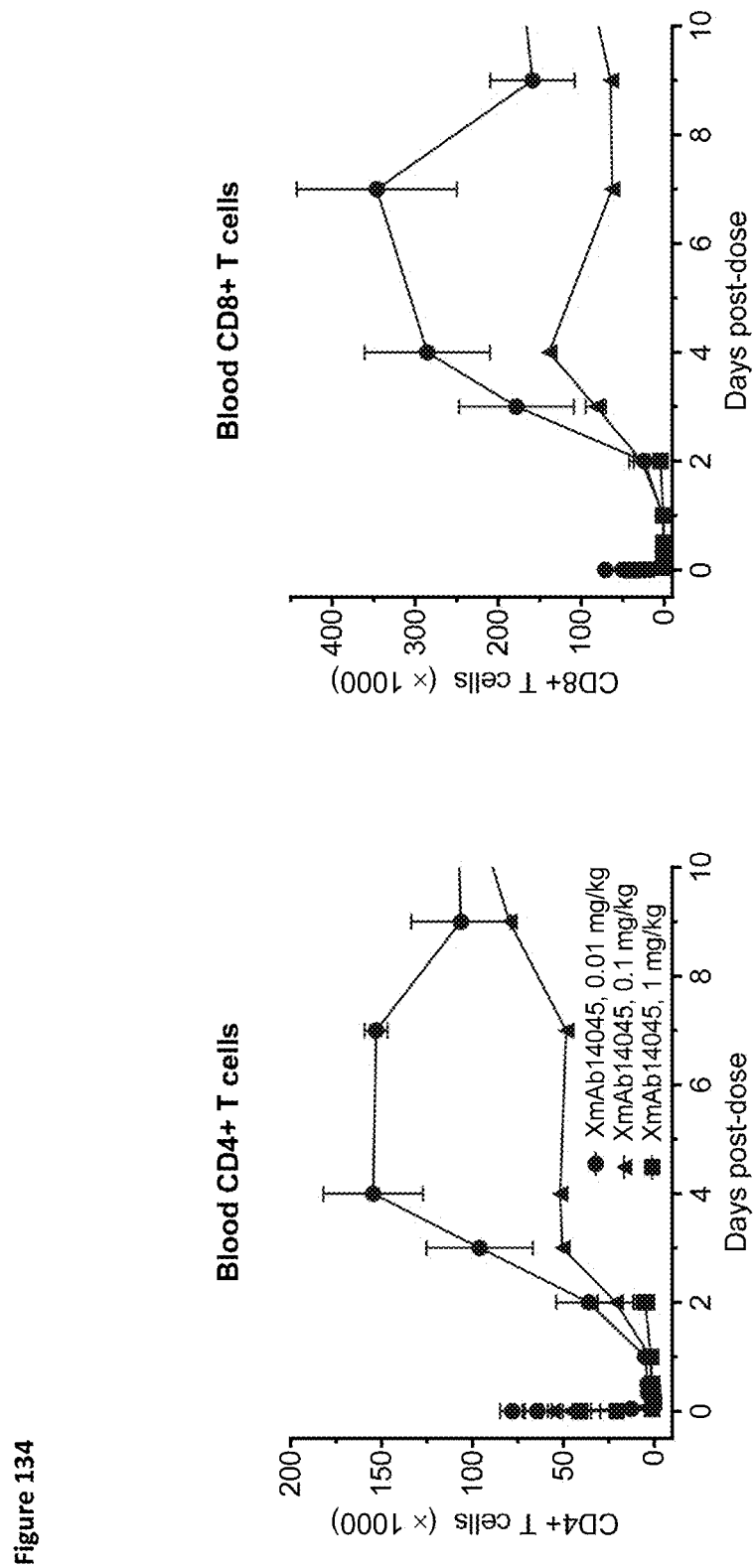
FIG. 134. Redistribution of T cells following a single IV dose of XENP14045 in cynomolgus monkeys.
Figure 135:
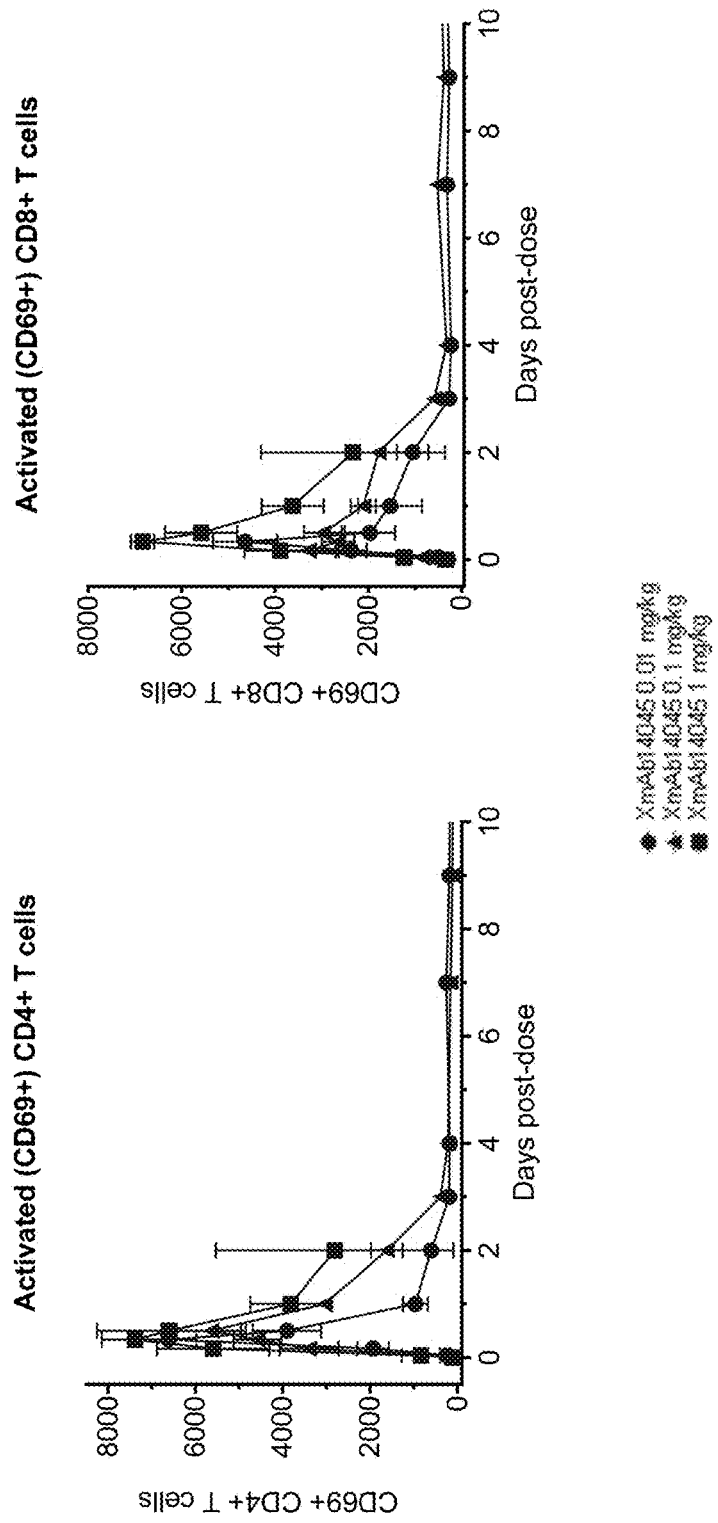
FIG. 135. CD69 induction of T cells following a single IV dose of XENP14045 in cynomolgus monkeys.
Figure 138:
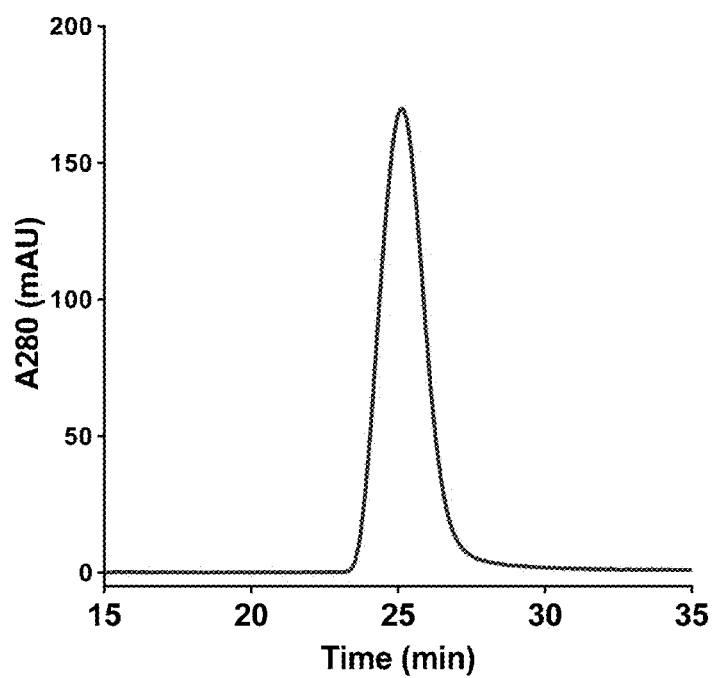
FIG. 138. SEC showing high purity of XENP14045 cell line material after two-step purification.
Figure 139:
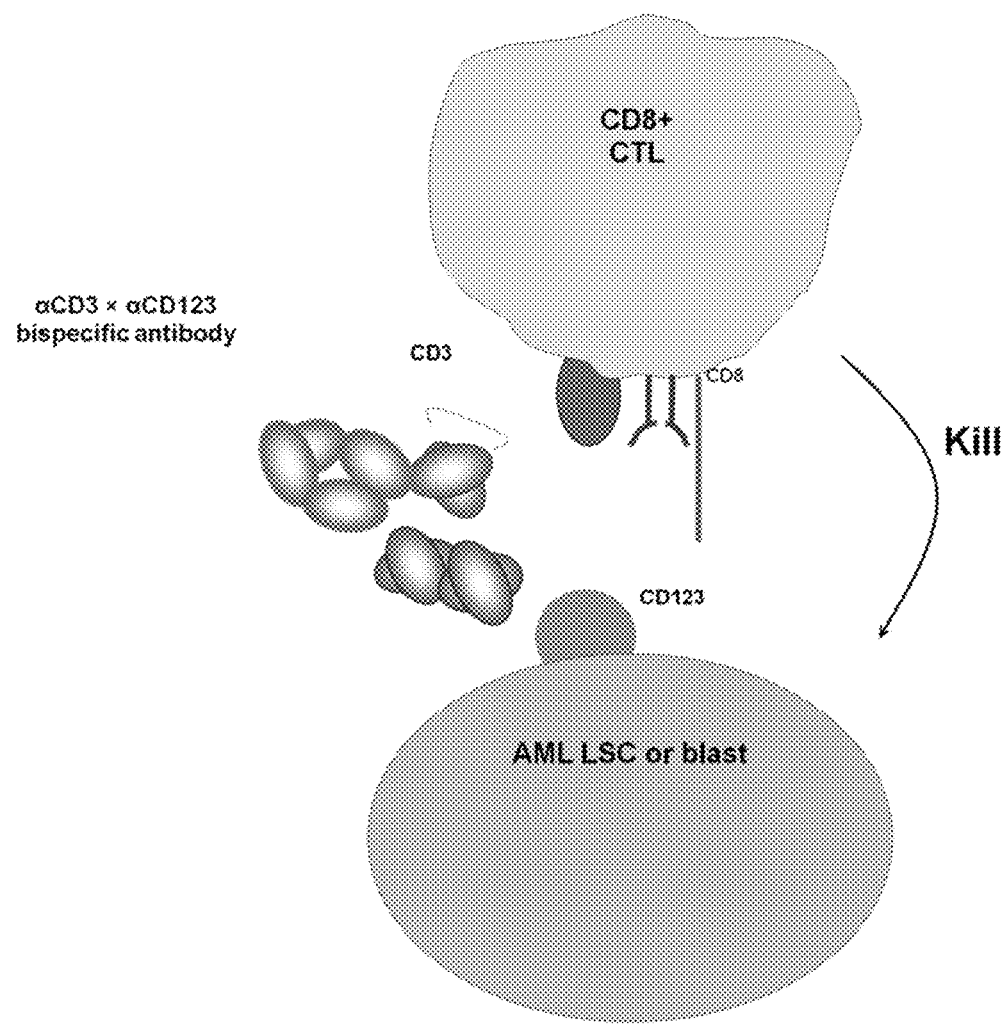
FIG. 139 depicts the T cell killing of CD123+ cells.
Figure 140:
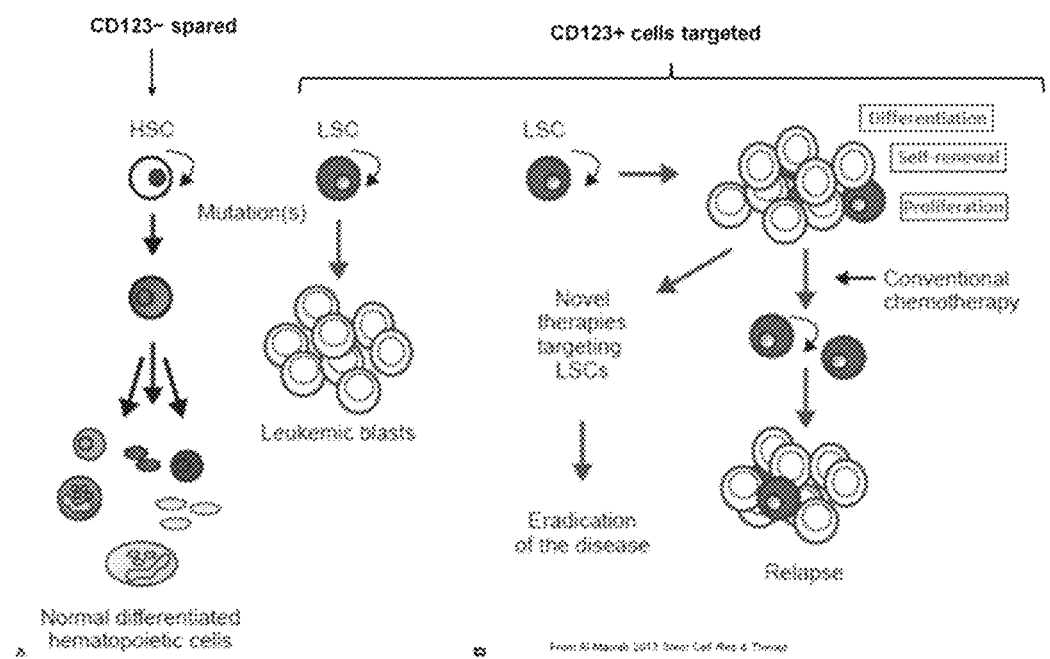
FIG. 140 depicts the bispecific mechanism to recruit cytotoxic T cells to kill AML stem cells and blasts.
Figure 141:
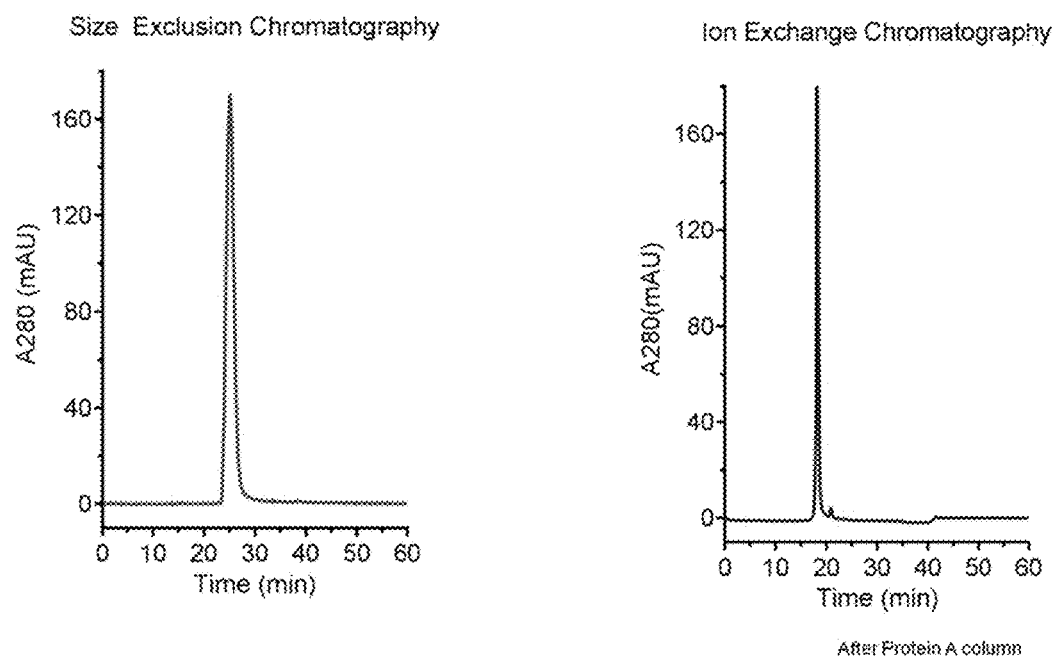
FIG. 141 depicts the efficient production of the XENP14045 bispecific.
Figure 142:
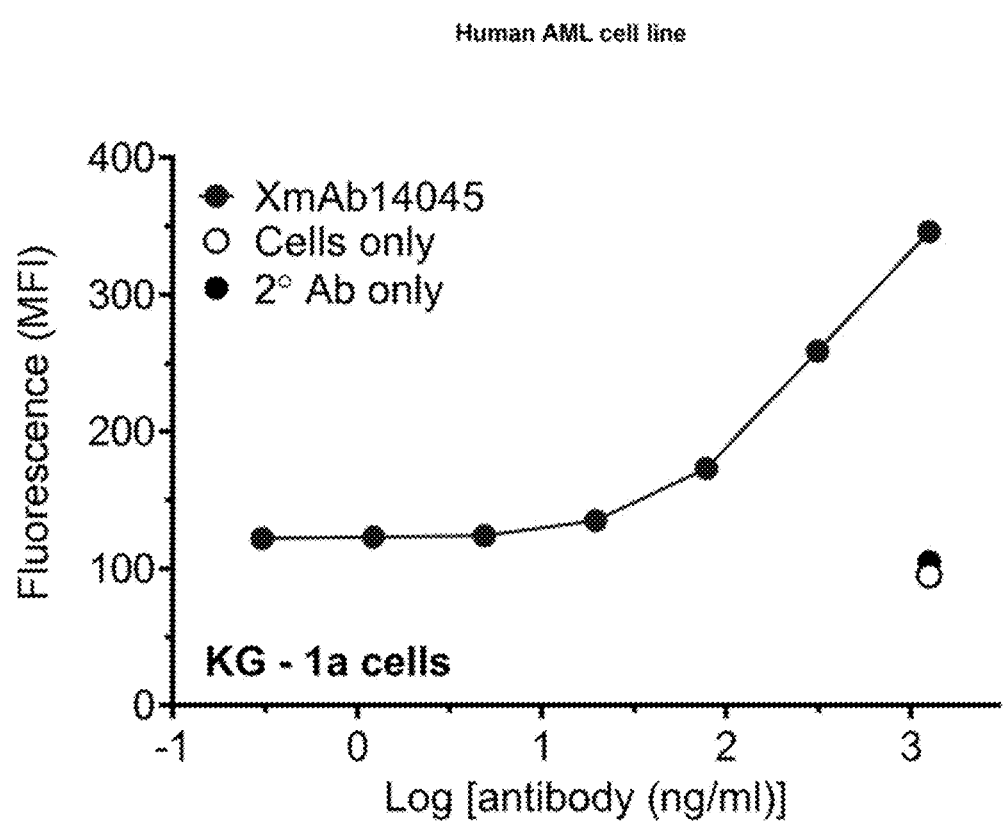
FIG. 142 shows that the XENP14045 bispecific antibody binds to human AML, with a KD of 8.1 nM to human CD3.
Figure 143:
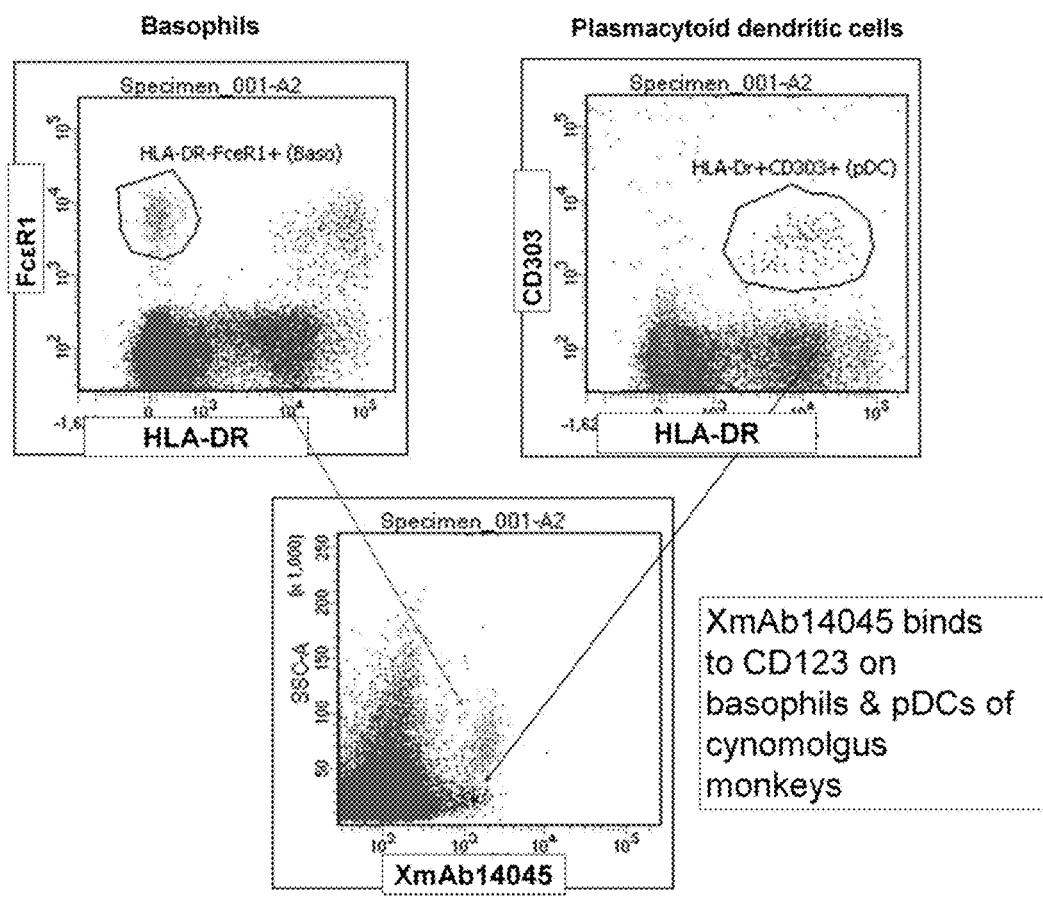
FIG. 143 shows that the XENP14045 bispecific antibody is cross reactive with primate cells, and has a KD of 5.7 nM to cyno CD3.
Figure 144:
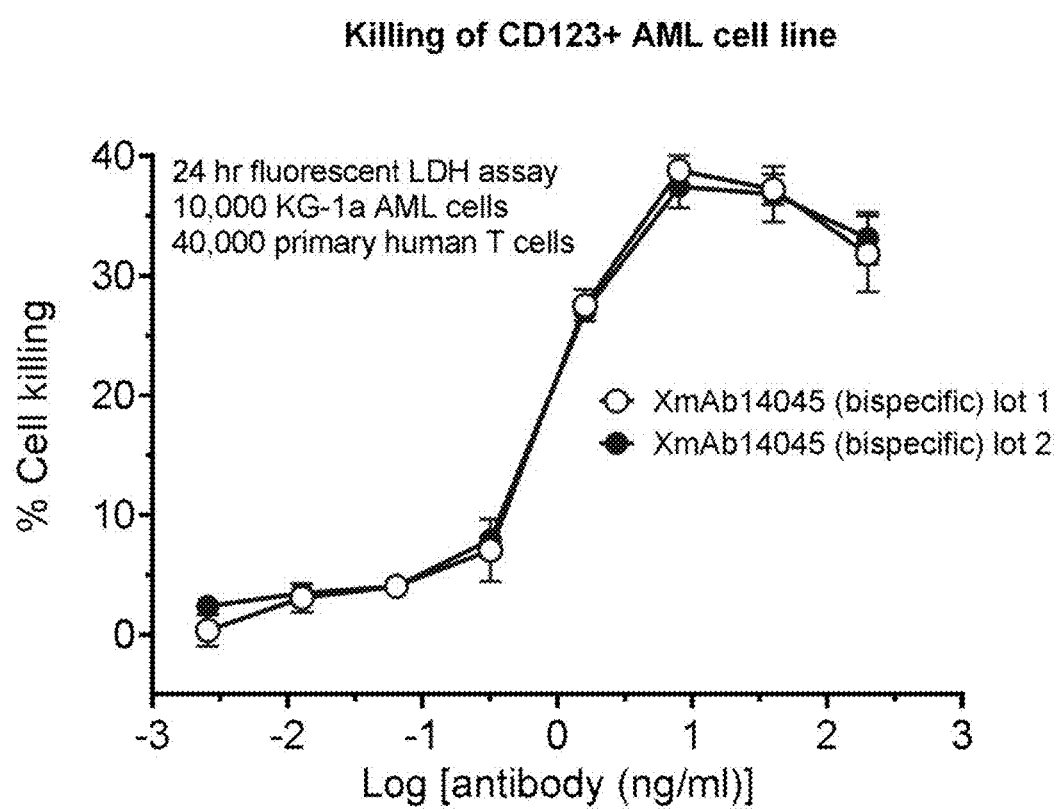
FIG. 144 shows that the anti-CD123×anti-CD3 kills human AML cell lines.
Figure 145:
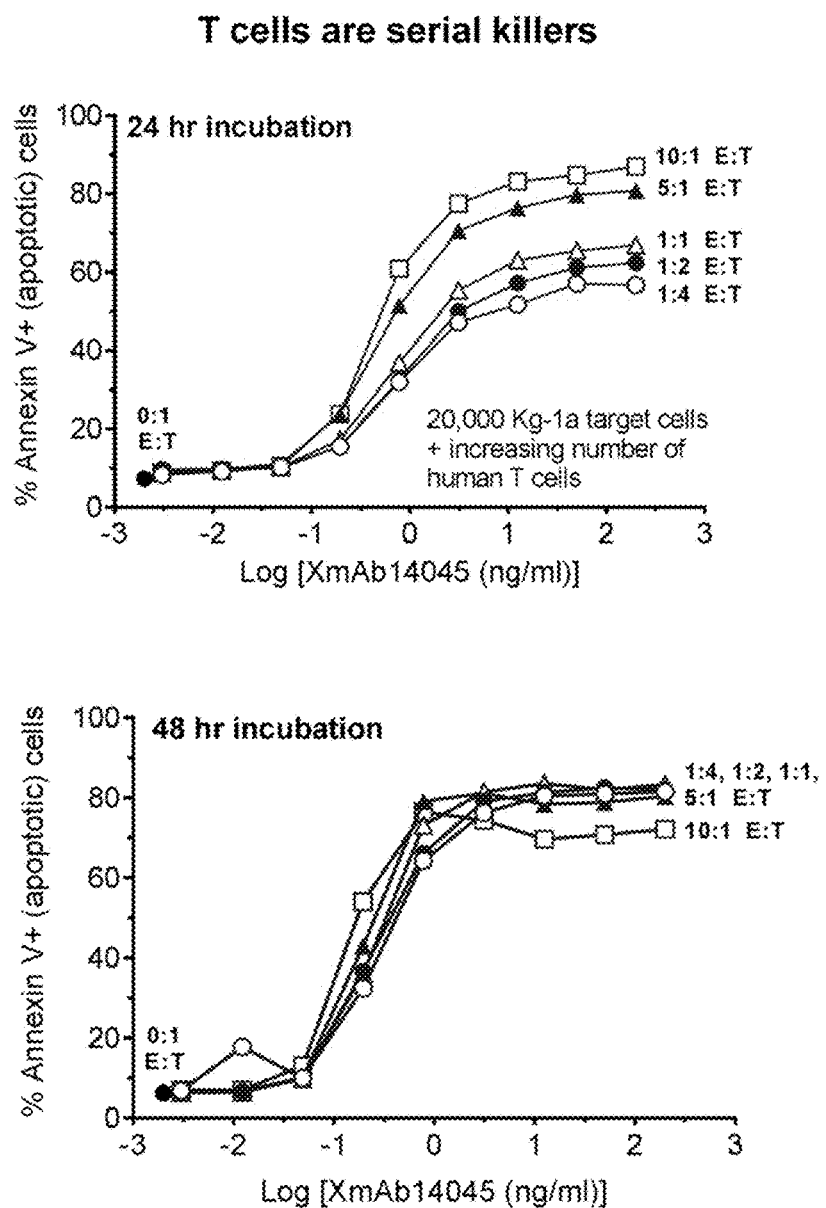
FIG. 145 shows that the anti-CD123×anti-CD3 kills human AML cell lines.
Figure 146:
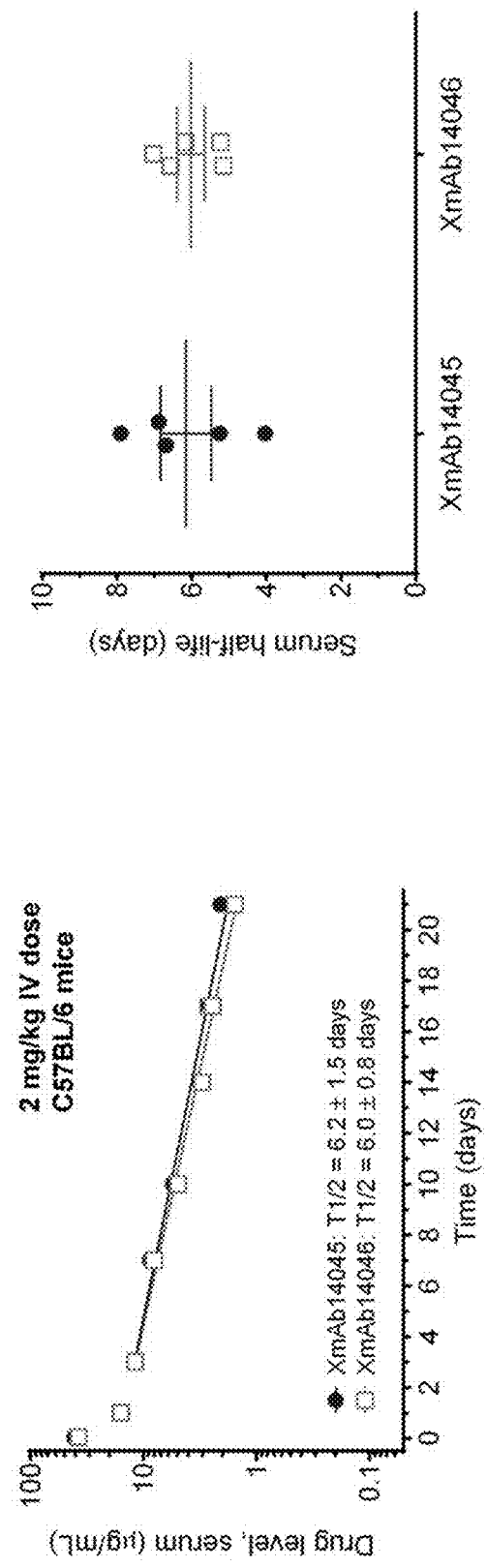
FIG. 146 shows the long half life of the bispecific in mice.
Figure 147:
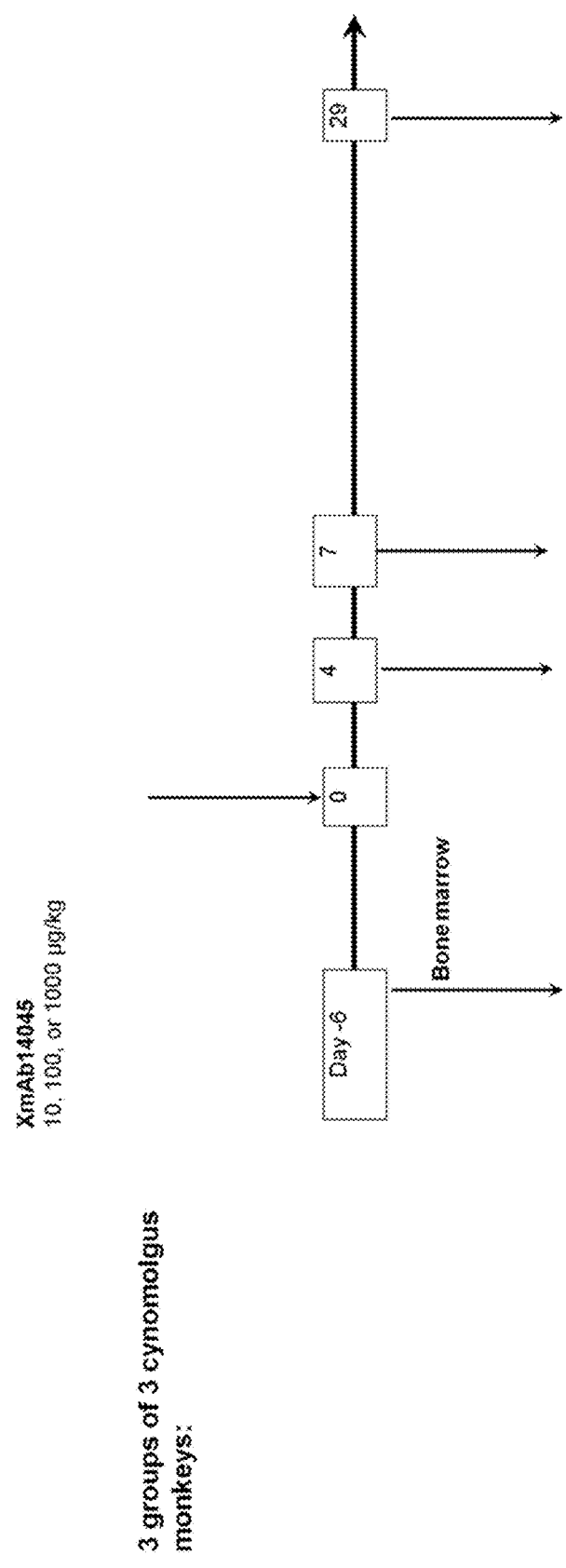
FIG. 147 shows the single dose in monkeys.
Figure 148:
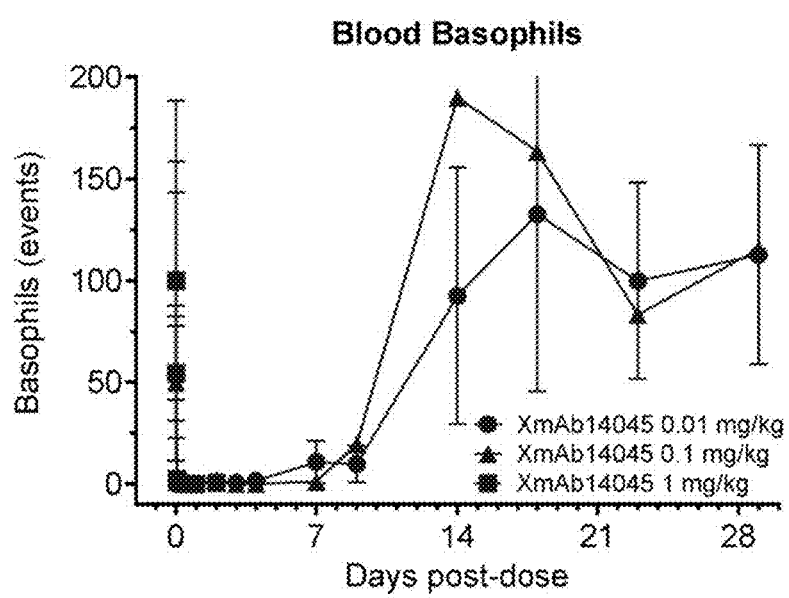
FIG. 148 shoes the depletion of CD123+ cells in monkeys in blood basophiles. Basophil gate, flow cytometry is CD20−CD16+CD14−CD4−CD8−FceR1+.
Figure 149:
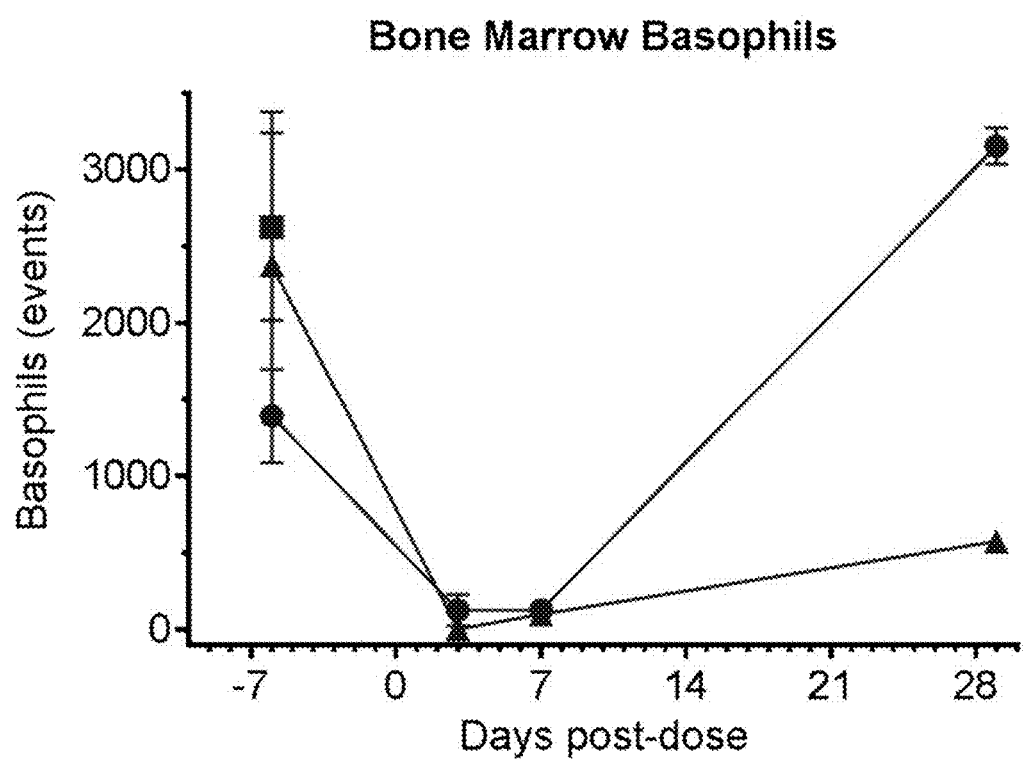
FIG. 149 shows the depletion in bone marrow basophils, using the same gating.
Figure 150:
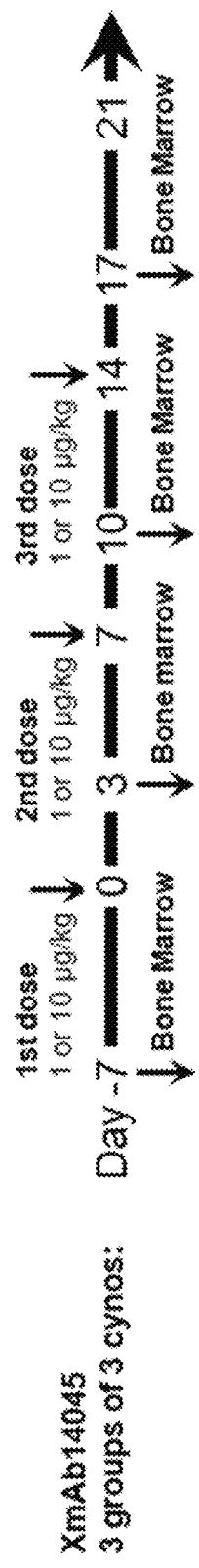
FIG. 150 shows the repeat dosing that depletes CD123+ cells in monkeys.
Figure 151:
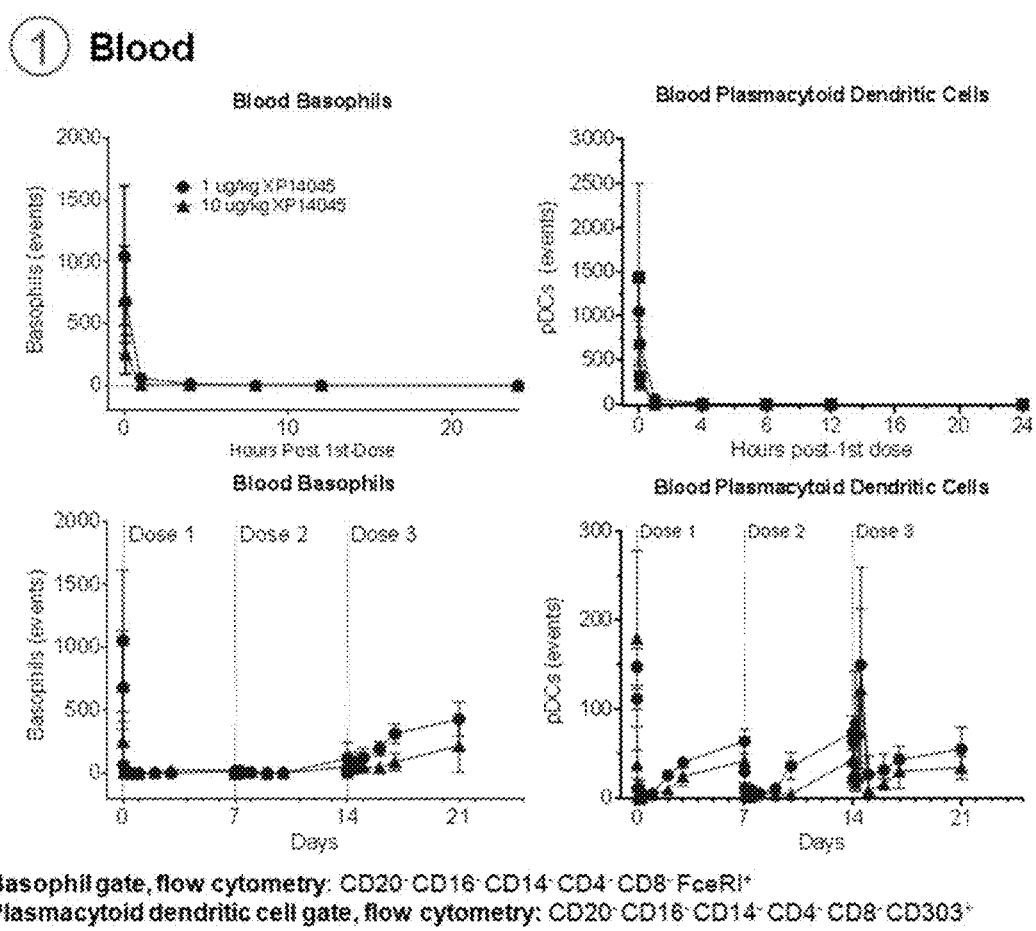
FIG. 151 shows the depletion of CD123+ cells in monkeys. Basophil gate, flow cytometry is CD20−CD16+CD14−CD4−CD8−FceR1+. Plasmoacytoid dendritic cell gate, flow cytometry: CD20−CD16−CD14−Cd4−CD8−CD303+.
Figure 152:
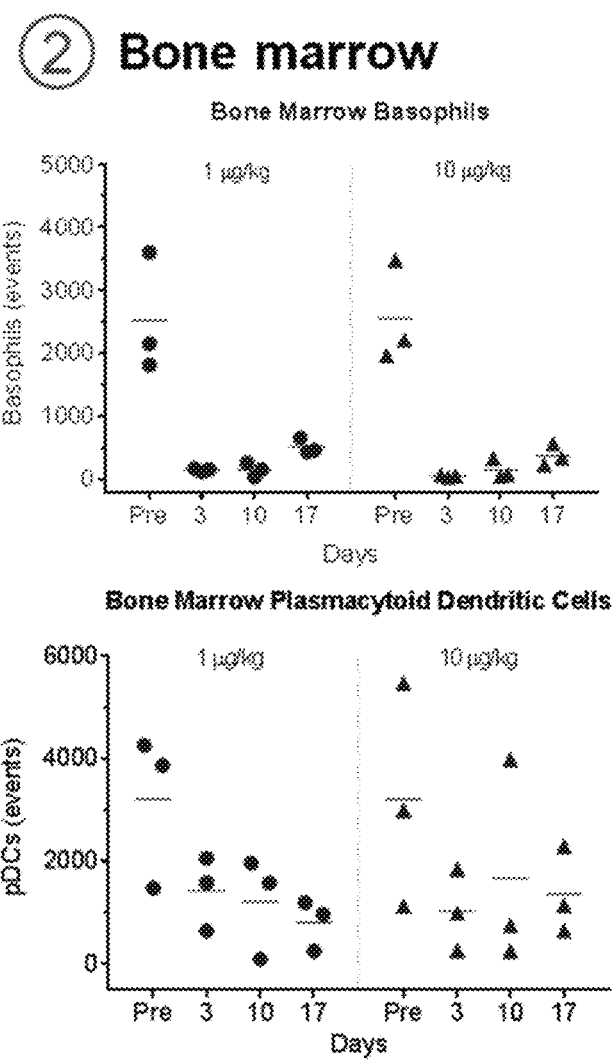
FIG. 152 shows depletion in bone marrow in monkeys. Gating as in FIG. 151.
Figure 153:
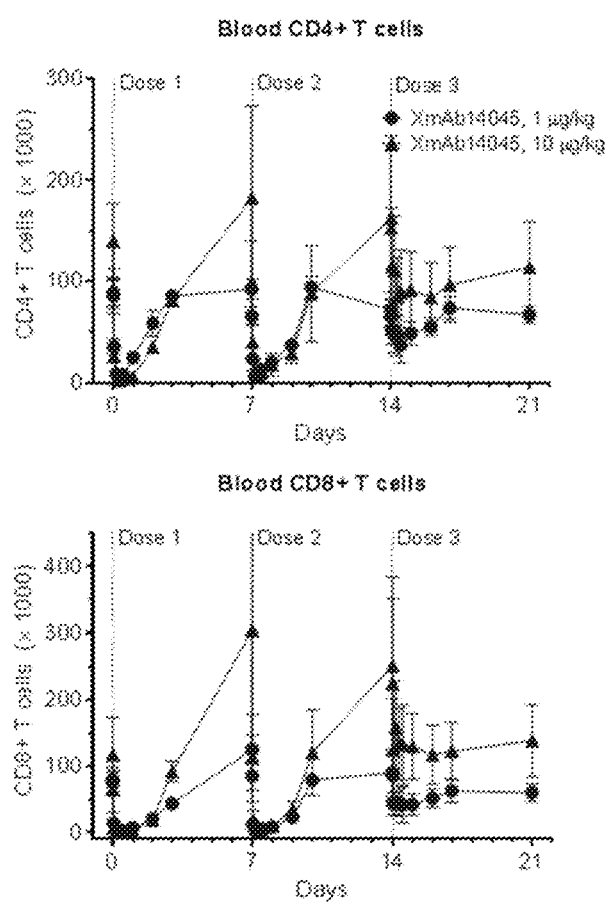
FIG. 153 shows the CD123+ cell depletion correlates with T cell redistribution and activation.
Figure 154:
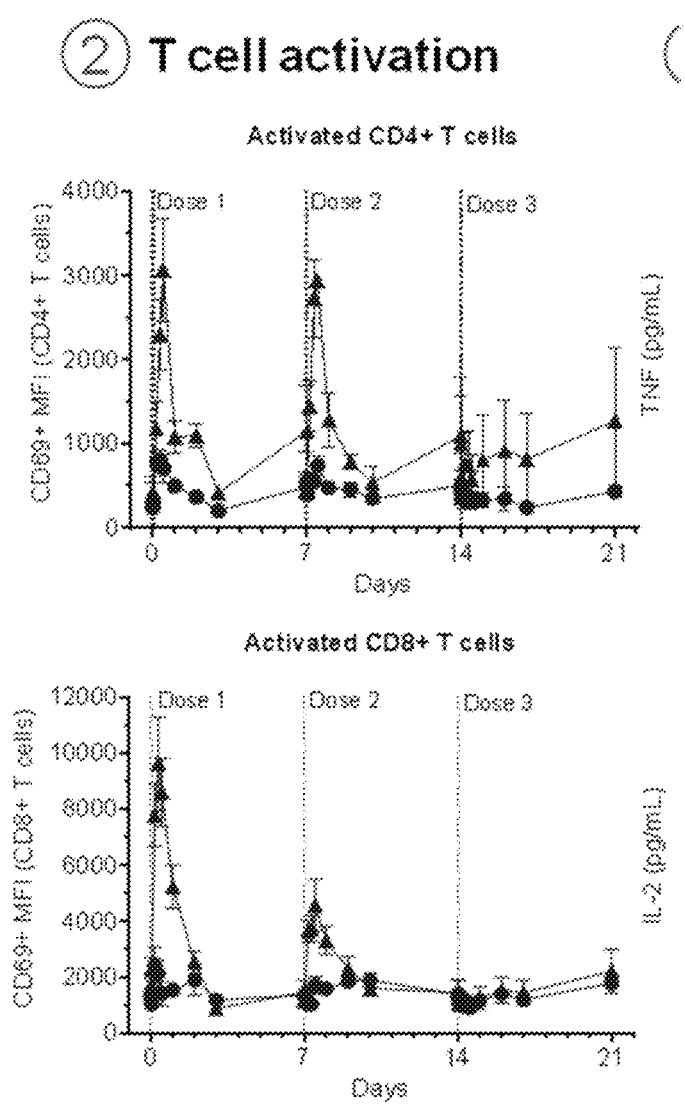
FIG. 154 shows the CD123+ cell depletion correlates with T cell redistribution and activation.
Figure 155:
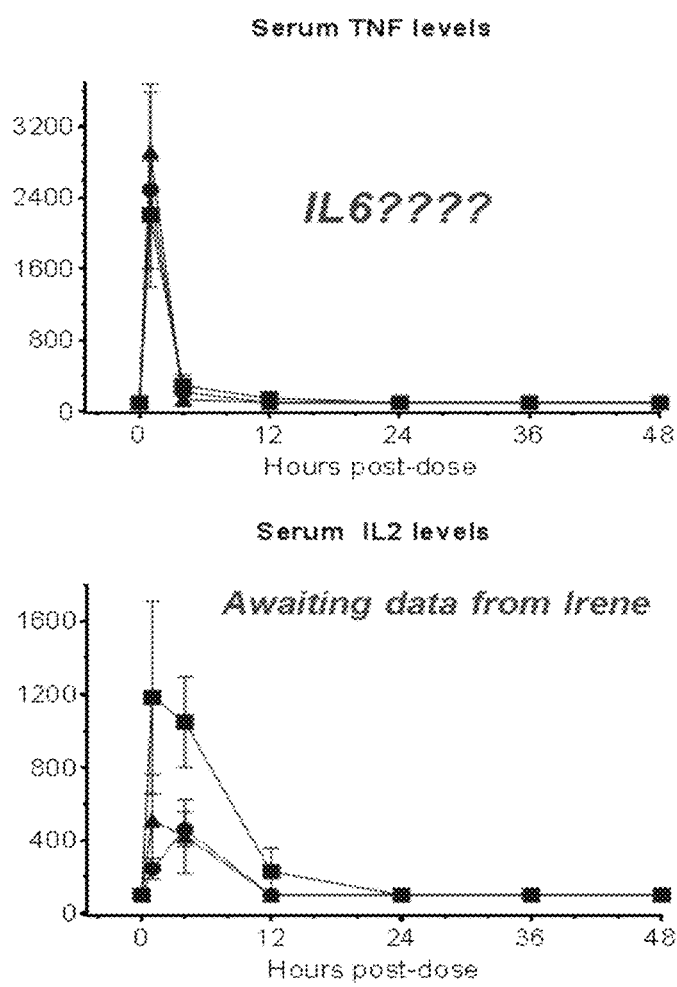
FIG. 155 shows the CD123+ cell depletion correlates with T cell redistribution and activation.

Cynomolgus monkeys were given a single dose of anti-CD38×anti-CD3 bispecifics. An anti-RSV×anti-CD3 bispecific control was also included. Dose levels were: 20 µg/kg XmAb13551 (n=2), 0.5 mg/kg XmAb15426 (n=3), 3 mg/kg XmAb14702 (n=3), or 3 mg/kg XmAb13245 (anti-RSV×anti-CD3 control, n=3) (in 3 independent studies). Anti-CD38×anti-CD3 bispecifics rapidly depleted CD38+ cells in peripheral blood (see FIG. 49). Anti-CD38×anti-CD3 bispecifics resulted in T cell activation as measured by CD69 expression (see FIG. 50). Serum levels of IL-6 were also measured (see FIG. 51). Note that, compared to XmAb13551, XmAb15426 had an increased duration of CD38+ cell depletion and lower levels of T cell activation and IL-6 production.

XmAb15426 and XmAb14702 were tested at single doses of 0.5 mg/kg and 3 mg/kg respectively. Both antibodies were well-tolerated at these higher doses, consistent with the moderate levels of IL6 observed in serum from the treated monkeys. Moreover, XmAb15426, with intermediate CD3 affinity, more effectively depleted CD38+ cells at 0.5 mg/kg compared to the original high-affinity XmAb13551 dosed at 2, 5 or 20 µg/kg. Depletion by XmAb15426 was more sustained compared to the highest dose of XmAb13551 in the previous study (7 vs. 2 days, respectively). Notably, although target cell depletion was greater for XmAb15426, T cell activation (CD69, CD25 and PD1 induction) was much lower in monkeys treated with XmAb15426 even dosed 25-fold higher than the 20 µg/kg XmAb13551 group. XmAb14702, with very low CD3 affinity, had little effect on CD38+ cells and T cell activation.

These results demonstrate that modulating T cell activation by attenuating CD3 affinity is a promising method to improve the therapeutic window of T cell-engaging bispecific antibodies. This strategy has potential to expand the set of antigens amenable to targeted T cell immunotherapy by improving tolerability and enabling higher dosing to overcome antigen sink clearance with targets such as CD38. We have shown that by reducing affinity for CD3, XmAb 15426 effectively depletes CD38+ cells while minimizing the CRS effects been with comparable doses of its high-affinity counterpart XmAb13551.

SEQUENCE LISTING (470 sequences)

SEQ ID NO: 1 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 2 - protein, 5 aa, Artificial Sequence
  source: /note="Description of Artificial Sequence: Synthetic peptide"
TYAMN

SEQ ID NO: 3 - protein, 19 aa, Artificial Sequence
  source: /note="Description of Artificial Sequence: Synthetic peptide"
RIRSKYNNYATYYADSVKG

SEQ ID NO: 4 - protein, 14 aa, Artificial Sequence
  source: /note="Description of Artificial Sequence: Synthetic peptide"
HGNFGDSYVSWFAY

SEQ ID NO: 5 - protein, 109 aa, Artificial Sequence
  source: /note="Description of Artificial Sequence: Synthetic polypeptide"
QAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 6 - protein, 14 aa, Artificial Sequence
  source: /note="Description of Artificial Sequence: Synthetic peptide"
GSSTGAVTTSNYAN

SEQ ID NO: 7 - protein, 7 aa, Artificial Sequence
  source: /note="Description of Artificial Sequence: Synthetic peptide"
GTNKRAP

SEQ ID NO: 8 - protein, 9 aa, Artificial Sequence
  source: /note="Description of Artificial Sequence: Synthetic peptide"
ALWYSNHWV

SEQ ID NO: 9 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 10 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSS

SEQ ID NO: 11 - protein, 5 aa, Artificial Sequence
  source: /note="Description of Artificial Sequence: Synthetic peptide"
TYAMN

SEQ ID NO: 12 - protein, 19 aa, Artificial Sequence
  source: /note="Description of Artificial Sequence: Synthetic peptide"
RIRSKANNYATYYADSVKG

SEQ ID NO: 13 - protein, 14 aa, Artificial Sequence
  source: /note="Description of Artificial Sequence: Synthetic peptide"
HGNFGDSYVSWFAY

SEQ ID NO: 14 - protein, 109 aa, Artificial Sequence; identical to SEQ ID NO: 5
  source: /note="Description of Artificial Sequence: Synthetic polypeptide"

SEQ ID NO: 15 - protein, 14 aa, Artificial Sequence
  source: /note="Description of Artificial Sequence: Synthetic peptide"
GSSTGAVTTSNYAN

SEQ ID NO: 16 - protein, 7 aa, Artificial Sequence
  source: /note="Description of Artificial Sequence: Synthetic peptide"
GTNKRAP

SEQ ID NO: 17 - protein, 9 aa, Artificial Sequence
  source: /note="Description of Artificial Sequence: Synthetic peptide"
ALWYSNHWV

SEQ ID NO: 18 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 19 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSS

SEQ ID NO: 20 - protein, 5 aa, Artificial Sequence
  source: /note="Description of Artificial Sequence: Synthetic peptide"
TYAMN

SEQ ID NO: 21 - protein, 19 aa, Artificial Sequence
  source: /note="Description of Artificial Sequence: Synthetic peptide"
RIRSKYNNYATYYADSVKG

SEQ ID NO: 22 - protein, 14 aa, Artificial Sequence
  source: /note="Description of Artificial Sequence: Synthetic peptide"
HGNFGDEYVSWFAY

SEQ ID NO: 23 - protein, 109 aa, Artificial Sequence; identical to SEQ ID NO: 5
  source: /note="Description of Artificial Sequence: Synthetic polypeptide"

SEQ ID NO: 24 - protein, 14 aa, Artificial Sequence
  source: /note="Description of Artificial Sequence: Synthetic peptide"
GSSTGAVTTSNYAN

SEQ ID NO: 25 - protein, 7 aa, Artificial Sequence
  source: /note="Description of Artificial Sequence: Synthetic peptide"
GTNKRAP

SEQ ID NO: 26 - protein, 9 aa, Artificial Sequence
  source: /note="Description of Artificial Sequence: Synthetic peptide"
ALWYSNHWV

SEQ ID NO: 27 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 28 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSS

SEQ ID NO: 29 - protein, 5 aa, Artificial Sequence
  source: /note="Description of Artificial Sequence: Synthetic peptide"
TYAMN

SEQ ID NO: 30 - protein, 19 aa, Artificial Sequence
  source: /note="Description of Artificial Sequence: Synthetic peptide"
RIRSKYNNYATYYADSVKG

SEQ ID NO: 31 - protein, 14 aa, Artificial Sequence
  source: /note="Description of Artificial Sequence: Synthetic peptide"
HGNFGDPYVSWFAY

SEQ ID NO: 32 - protein, 109 aa, Artificial Sequence; identical to SEQ ID NO: 5
  source: /note="Description of Artificial Sequence: Synthetic polypeptide"

SEQ ID NO: 33 - protein, 14 aa, Artificial Sequence
  source: /note="Description of Artificial Sequence: Synthetic peptide"
GSSTGAVTTSNYAN

SEQ ID NO: 34 - protein, 7 aa, Artificial Sequence
  source: /note="Description of Artificial Sequence: Synthetic peptide"
GTNKRAP

SEQ ID NO: 35 - protein, 9 aa, Artificial Sequence
  source: /note="Description of Artificial Sequence: Synthetic peptide"
ALWYSNHWV

SEQ ID NO: 36 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 37 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSS

SEQ ID NO: 38 - protein, 5 aa, Artificial Sequence
  source: /note="Description of Artificial Sequence: Synthetic peptide"
TYAMN

SEQ ID NO: 39 - protein, 19 aa, Artificial Sequence
  source: /note="Description of Artificial Sequence: Synthetic peptide"
RIRSKYNNYATYYADSVKG

SEQ ID NO: 40 - protein, 14 aa, Artificial Sequence
  source: /note="Description of Artificial Sequence: Synthetic peptide"
HGNFGDSYVSWFDY

SEQ ID NO: 41 - protein, 109 aa, Artificial Sequence; identical to SEQ ID NO: 5
  source: /note="Description of Artificial Sequence: Synthetic polypeptide"

SEQ ID NO: 42 - protein, 14 aa, Artificial Sequence
  source: /note="Description of Artificial Sequence: Synthetic peptide"
GSSTGAVTTSNYAN

SEQ ID NO: 43 - protein, 7 aa, Artificial Sequence
  source: /note="Description of Artificial Sequence: Synthetic peptide"
GTNKRAP

SEQ ID NO: 44 - protein, 9 aa, Artificial Sequence
  source: /note="Description of Artificial Sequence: Synthetic peptide"
ALWYSNHWV

SEQ ID NO: 45 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 46 - protein, 125 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 47 - protein, 5 aa, Artificial Sequence
  source: /note="Description of Artificial Sequence: Synthetic peptide"
TYAMS

SEQ ID NO: 48 - protein, 19 aa, Artificial Sequence
  source: /note="Description of Artificial Sequence: Synthetic peptide"
RIRSKYNNYATYYADSVKG

SEQ ID NO: 49 - protein, 14 aa, Artificial Sequence
  source: /note="Description of Artificial Sequence: Synthetic peptide"
HGNFGDSYVSWFAY

SEQ ID NO: 50 - protein, 109 aa, Artificial Sequence; identical to SEQ ID NO: 5
  source: /note="Description of Artificial Sequence: Synthetic polypeptide"

SEQ ID NO: 51 - protein, 14 aa, Artificial Sequence
  source: /note="Description of Artificial Sequence: Synthetic peptide"
GSSTGAVTTSNYAN

SEQ ID NO: 52 - protein, 7 aa, Artificial Sequence
  source: /note="Description of Artificial Sequence: Synthetic peptide"
GTNKRAP

SEQ ID NO: 53 - protein, 9 aa, Artificial Sequence
  source: /note="Description of Artificial Sequence: Synthetic peptide"
ALWYSNHWV

SEQ ID NO: 54 - protein, 254 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 55 - protein, 116 aa, Artificial Sequence
  source: /note="Description of Artificial Sequence: Synthetic polypeptide"
EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWGQGTLVTVSS

SEQ ID NO: 56 - protein, 5 aa, Artificial Sequence
  source: /note="Description of Artificial Sequence: Synthetic peptide"
YSWMN

SEQ ID NO: 57 - protein, 17 aa, Artificial Sequence
  source: /note="Description of Artificial Sequence: Synthetic peptide"
EINPQSSTINYATSVKG

SEQ ID NO: 58 - protein, 7 aa, Artificial Sequence
  source: /note="Description of Artificial Sequence: Synthetic peptide"
YGNWFPY

SEQ ID NO: 59 - protein, 107 aa, Artificial Sequence
  source: /note="Description of Artificial Sequence: Synthetic polypeptide"
DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK

SEQ ID NO: 60 - protein, 11 aa, Artificial Sequence
  source: /note="Description of Artificial Sequence: Synthetic peptide"
RASQNVDTWVA

SEQ ID NO: 61 - protein, 7 aa, Artificial Sequence
  source: /note="Description of Artificial Sequence: Synthetic peptide"
SASYRYS

SEQ ID NO: 62 - protein, 9 aa, Artificial Sequence
  source: /note="Description of Artificial Sequence: Synthetic peptide"
QQYDSYPLT

SEQ ID NO: 63 - protein, 243 aa, Artificial Sequence
  source: /note="Description of Artificial Sequence: Synthetic polypeptide"
EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWGQGTLVTVSSGKPGSGKPGSGKPGSGKPGSDIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK

SEQ ID NO: 64 - protein, 116 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSS

SEQ ID NO: 65 - protein, 5 aa, Artificial Sequence
  source: /note="Description of Artificial Sequence: Synthetic peptide"
RSWMN

SEQ ID NO: 66 - protein, 17 aa, Artificial Sequence
  source: /note="Description of Artificial Sequence: Synthetic peptide"
EINPDSSTINYATSVKG

SEQ ID NO: 67 - protein, 7 aa, Artificial Sequence
  source: /note="Description of Artificial Sequence: Synthetic peptide"
YGNWFPY

SEQ ID NO: 68 - protein, 107 aa, Artificial Sequence; identical to SEQ ID NO: 59
  source: /note="Description of Artificial Sequence: Synthetic polypeptide"

SEQ ID NO: 69 - protein, 11 aa, Artificial Sequence
  source: /note="Description of Artificial Sequence: Synthetic peptide"
RASQNVDTWVA

SEQ ID NO: 70 - protein, 7 aa, Artificial Sequence
  source: /note="Description of Artificial Sequence: Synthetic peptide"
SASYRYS

SEQ ID NO: 71 - protein, 9 aa, Artificial Sequence
  source: /note="Description of Artificial Sequence: Synthetic peptide"
QQYDSYPLT

SEQ ID NO: 72 - protein, 243 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSGKPGSGKPGSGKPGSGKPGSDIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIK

SEQ ID NO: 73 - protein, 116 aa, Artificial Sequence; identical to SEQ ID NO: 64
  source: /note="Description of Artificial Sequence: Synthetic polypeptide"

SEQ ID NO: 74 - protein, 5 aa, Artificial Sequence
  source: /note="Description of Artificial Sequence: Synthetic peptide"
RSWMN

SEQ ID NO: 75 - protein, 17 aa, Artificial Sequence
  source: /note="Description of Artificial Sequence: Synthetic peptide"
EINPDSSTINYATSVKG

SEQ ID NO: 76 - protein, 7 aa, Artificial Sequence
  source: /note="Description of Artificial Sequence: Synthetic peptide"
YGNWFPY

SEQ ID NO: 77 - protein, 116 aa, Artificial Sequence; identical to SEQ ID NO: 64
  source: /note="Description of Artificial Sequence: Synthetic polypeptide"

SEQ ID NO: 78 - protein, 11 aa, Artificial Sequence
  source: /note="Description of Artificial Sequence: Synthetic peptide"
RASQNVDTNVA

SEQ ID NO: 79 - protein, 7 aa, Artificial Sequence
  source: /note="Description of Artificial Sequence: Synthetic peptide"
SASYRYS

SEQ ID NO: 80 - protein, 9 aa, Artificial Sequence
  source: /note="Description of Artificial Sequence: Synthetic peptide"
QQYDSYPLT

SEQ ID NO: 81 - protein, 252 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSGKPGSGKPGSGKPGSGKPGSEVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSS

SEQ ID NO: 82 - protein, 445 aa, Artificial Sequence
  source: /note="Description of Artificial Sequence: Synthetic polypeptide"
EVQLVESGGGLVQPGGSLRLSCAASGFTFSYSWMNWVRQAPGKGLEWVSEINPQSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 83 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 214 aa, Artificial Sequence
  source: /note="Description of Artificial Sequence: Synthetic polypeptide"
DIVMTQSPSSLSASVGDRVTITCRASQNVDTWVAWYQQKPGQSPKALIYSASYRYSGVPDRFTGSGSGTDFTLTISSLQPEDFATYFCQQYDSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 445 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 86 - protein, 485 aa, Artificial Sequence; identical to SEQ ID NO: 83
  source: /note="Description of Artificial Sequence: Synthetic polypeptide"

SEQ ID NO: 87 - protein, 214 aa, Artificial Sequence
  source: /note="Description of Artificial Sequence: Synthetic polypeptide"
DIVMTQSPSSLSASVGDRVTITCRASQNVDTNVAWYQQKPGQSPKALIYSASYRYSGVPDRFTGSGSGTDFTLTISSLQPEDFATYFCQQYDSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 445 aa, Artificial Sequence; identical to SEQ ID NO: 82
  source: /note="Description of Artificial Sequence: Synthetic polypeptide"

SEQ ID NO: 89 - protein, 485 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 214 aa, Artificial Sequence; identical to SEQ ID NO: 84
  source: /note="Description of Artificial Sequence: Synthetic polypeptide"

SEQ ID NO: 91 - protein, 445 aa, Artificial Sequence; identical to SEQ ID NO: 82
  source: /note="Description of Artificial Sequence: Synthetic polypeptide"

SEQ ID NO: 92 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 214 aa, Artificial Sequence; identical to SEQ ID NO: 84
  source: /note="Description of Artificial Sequence: Synthetic polypeptide"

SEQ ID NO: 94 - protein, 445 aa, Artificial Sequence; identical to SEQ ID NO: 85
  source: /note="Description of Artificial Sequence: Synthetic polypeptide"

SEQ ID NO: 95 - protein, 485 aa, Artificial Sequence; identical to SEQ ID NO: 89
  source: /note="Description of Artificial Sequence: Synthetic polypeptide"

SEQ ID NO: 96 - protein, 214 aa, Artificial Sequence; identical to SEQ ID NO: 87
  source: /note="Description of Artificial Sequence: Synthetic polypeptide"

SEQ ID NO: 97 - protein, 445 aa, Artificial Sequence; identical to SEQ ID NO: 85
  source: /note="Description of Artificial Sequence: Synthetic polypeptide"

SEQ ID NO: 98 - protein, 485 aa, Artificial Sequence; identical to SEQ ID NO: 89
  source: /note="Description of Artificial Sequence: Synthetic polypeptide"

SEQ ID NO: 99 - protein, 214 aa, Artificial Sequence
  source: /note="Description of Artificial Sequence: Synthetic polypeptide"
DIVMTQSPSSLSASVGDRVTITCRASQNVDTNVAWYQQKPGQSPKALIYSASYRKSGVPDRFTGSGSGTDFTLTISSLQPEDFATYFCQQYDSYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 100 - protein, 445 aa, Artificial Sequence; identical to SEQ ID NO: 85
  source: /note="Description of Artificial Sequence: Synthetic polypeptide"

SEQ ID NO: 101 - protein, 485 aa, Artificial Sequence; identical to SEQ ID NO: 83
  source: /note="Description of Artificial Sequence: Synthetic polypeptide"

SEQ ID NO: 102 - protein, 214 aa, Artificial Sequence; identical to SEQ ID NO: 87
  source: /note="Description of Artificial Sequence: Synthetic polypeptide"

SEQ ID NO: 103 - protein, 445 aa, Artificial Sequence; identical to SEQ ID NO: 82
  source: /note="Description of Artificial Sequence: Synthetic polypeptide"

SEQ ID NO: 104 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 214 aa, Artificial Sequence; identical to SEQ ID NO: 84
  source: /note="Description of Artificial Sequence: Synthetic polypeptide"

SEQ ID NO: 106 - protein, 445 aa, Artificial Sequence; identical to SEQ ID NO: 85
  source: /note="Description of Artificial Sequence: Synthetic polypeptide"

SEQ ID NO: 107 - protein, 485 aa, Artificial Sequence; identical to SEQ ID NO: 104
  source: /note="Description of Artificial Sequence: Synthetic polypeptide"

SEQ ID NO: 108 - protein, 214 aa, Artificial Sequence; identical to SEQ ID NO: 87
  source: /note="Description of Artificial Sequence: Synthetic polypeptide"

SEQ ID NO: 109 - protein, 445 aa, Artificial Sequence; identical to SEQ ID NO: 85
  source: /note="Description of Artificial Sequence: Synthetic polypeptide"

SEQ ID NO: 110 - protein, 485 aa, Artificial Sequence; identical to SEQ ID NO: 92
  source: /note="Description of Artificial Sequence: Synthetic polypeptide"

SEQ ID NO: 111 - protein, 214 aa, Artificial Sequence; identical to SEQ ID NO: 84
  source: /note="Description of Artificial Sequence: Synthetic polypeptide"

SEQ ID NO: 112 - protein, 445 aa, Artificial Sequence; identical to SEQ ID NO: 85
  source: /note="Description of Artificial Sequence: Synthetic polypeptide"

SEQ ID NO: 113 - protein, 485 aa, Artificial Sequence; identical to SEQ ID NO: 89
  source: /note="Description of Artificial Sequence: Synthetic polypeptide"

SEQ ID NO: 114 - protein, 214 aa, Artificial Sequence; identical to SEQ ID NO: 84
  source: /note="Description of Artificial Sequence: Synthetic polypeptide"

SEQ ID NO: 115 - protein, 445 aa, Artificial Sequence; identical to SEQ ID NO: 85
  source: /note="Description of Artificial Sequence: Synthetic polypeptide"

SEQ ID NO: 116 - protein, 485 aa, Artificial Sequence; identical to SEQ ID NO: 92
  source: /note="Description of Artificial Sequence: Synthetic polypeptide"

SEQ ID NO: 117 - protein, 214 aa, Artificial Sequence; identical to SEQ ID NO: 87
  source: /note="Description of Artificial Sequence: Synthetic polypeptide"

SEQ ID NO: 118 - protein, 445 aa, Artificial Sequence; identical to SEQ ID NO: 85
  source: /note="Description of Artificial Sequence: Synthetic polypeptide"

SEQ ID NO: 119 - protein, 485 aa, Artificial Sequence; identical to SEQ ID NO: 89
  source: /note="Description of Artificial Sequence: Synthetic polypeptide"

SEQ ID NO: 120 - protein, 214 aa, Artificial Sequence; identical to SEQ ID NO: 87
  source: /note="Description of Artificial Sequence: Synthetic polypeptide"

SEQ ID NO: 121 - protein, 445 aa, Artificial Sequence; identical to SEQ ID NO: 85
  source: /note="Description of Artificial Sequence: Synthetic polypeptide"

SEQ ID NO: 122 - protein, 485 aa, Artificial Sequence; identical to SEQ ID NO: 92
  source: /note="Description of Artificial Sequence: Synthetic polypeptide"

SEQ ID NO: 123 - protein, 214 aa, Artificial Sequence; identical to SEQ ID NO: 87
  source: /note="Description of Artificial Sequence: Synthetic polypeptide"

SEQ ID NO: 124 - protein, 445 aa, Artificial Sequence; identical to SEQ ID NO: 85
  source: /note="Description of Artificial Sequence: Synthetic polypeptide"

SEQ ID NO: 125 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKCLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGCGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 214 aa, Artificial Sequence; identical to SEQ ID NO: 87
  source: /note="Description of Artificial Sequence: Synthetic polypeptide"

SEQ ID NO: 127 - protein, 445 aa, Artificial Sequence; identical to SEQ ID NO: 82
  source: /note="Description of Artificial Sequence: Synthetic polypeptide"

SEQ ID NO: 128 - protein, 485 aa, Artificial Sequence; identical to SEQ ID NO: 125
  source: /note="Description of Artificial Sequence: Synthetic polypeptide"

SEQ ID NO: 129 - protein, 214 aa, Artificial Sequence; identical to SEQ ID NO: 84
  source: /note="Description of Artificial Sequence: Synthetic polypeptide"

SEQ ID NO: 130 - protein, 207 aa, Homo sapiens
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 131 - protein, 300 aa, Homo sapiens
MANCEFSPVSGDKPCCRLSRRAQLCLGVSILVLILVVVLAVVVPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 132 - protein, 258 aa, Homo sapiens
VPRWRQQWSGPGTTKRFPETVLARCVKYTEIHPEMRHVDCQSVWDAFKGAFISKHPCNITEEDYQPLMKLGTQTVPCNKILLWSRIKDLAHQFTQVQRDMFTLEDTLLGYLADDLTWCGEFNTSKINYQSCPDWRKDCSNNPVSVFWKTVSRRFAEAACDVVHVMLNGSRSKIFDKNSTFGSVEVHNLQPEKVQTLEAWVIHGGREDSRDLCQDPTIKELESIISKRNIQFSCKNIYRPDKFLQCVKNPEDSSCTSEI

SEQ ID NO: 133 - protein, 15 aa, Artificial Sequence
  source: /note="Description of Artificial Sequence: Synthetic peptide"
GGGGSGGGGSGGGGS

SEQ ID NO: 134 - protein, 18 aa, Artificial Sequence
  source: /note="Description of Artificial Sequence: Synthetic peptide"
GSTSGSGKPGSGEGSTKG

SEQ ID NO: 135 - protein, 14 aa, Artificial Sequence
  source: /note="Description of Artificial Sequence: Synthetic peptide"
IRPRAIGGSKPRVA

SEQ ID NO: 136 - protein, 15 aa, Artificial Sequence
  source: /note="Description of Artificial Sequence: Synthetic peptide"
GKGGSGKGGSGKGGS

SEQ ID NO: 137 - protein, 15 aa, Artificial Sequence
  source: /note="Description of Artificial Sequence: Synthetic peptide"
GGKGSGGKGSGGKGS

SEQ ID NO: 138 - protein, 15 aa, Artificial Sequence
  source: /note="Description of Artificial Sequence: Synthetic peptide"
GGGKSGGGKSGGGKS

SEQ ID NO: 139 - protein, 15 aa, Artificial Sequence
  source: /note="Description of Artificial Sequence: Synthetic peptide"
GKGKSGKGKSGKGKS

SEQ ID NO: 140 - protein, 15 aa, Artificial Sequence
  source: /note="Description of Artificial Sequence: Synthetic peptide"
GGGKSGGKGSGKGGS

SEQ ID NO: 141 - protein, 15 aa, Artificial Sequence
  source: /note="Description of Artificial Sequence: Synthetic peptide"
GKPGSGKPGSGKPGS

SEQ ID NO: 142 - protein, 20 aa, Artificial Sequence
  source: /note="Description of Artificial Sequence: Synthetic peptide"
GKPGSGKPGSGKPGSGKPGS

SEQ ID NO: 143 - protein, 20 aa, Artificial Sequence
  source: /note="Description of Artificial Sequence: Synthetic peptide"
GKGKSGKGKSGKGKSGKGKS

SEQ ID NO: 144 - protein, 20 aa, Artificial Sequence
  source: /note="Description of Artificial Sequence: Synthetic peptide"
GGGGSGGGGSGGGGSGGGGS

SEQ ID NO: 145 - protein, 14 aa, Artificial Sequence
  source: /note="Description of Artificial Sequence: Synthetic peptide"
STAGDTHLGGEDFD

SEQ ID NO: 146 - protein, 15 aa, Artificial Sequence
  source: /note="Description of Artificial Sequence: Synthetic peptide"
GEGGSGEGGSGEGGS

SEQ ID NO: 147 - protein, 15 aa, Artificial Sequence
  source: /note="Description of Artificial Sequence: Synthetic peptide"
GGEGSGGEGSGGEGS

SEQ ID NO: 148 - protein, 15 aa, Artificial Sequence
  source: /note="Description of Artificial Sequence: Synthetic peptide"
GGGESGGGESGGGES

SEQ ID NO: 149 - protein, 15 aa, Artificial Sequence
  source: /note="Description of Artificial Sequence: Synthetic peptide"
GEGESGEGESGEGES

SEQ ID NO: 150 - protein, 15 aa, Artificial Sequence
  source: /note="Description of Artificial Sequence: Synthetic peptide"
GGGESGGEGSGEGGS

SEQ ID NO: 151 - protein, 20 aa, Artificial Sequence
  source: /note="Description of Artificial Sequence: Synthetic peptide"
GEGESGEGESGEGESGEGES

SEQ ID NO: 152 - protein, 15 aa, Artificial Sequence
  source: /note="Description of Artificial Sequence: Synthetic peptide"
GGGGSGGGGSGGGGS

SEQ ID NO: 153 - protein, 20 aa, Artificial Sequence
  source: /note="Description of Artificial Sequence: Synthetic peptide"
GGGGSGGGGSGGGGSGGGGS

SEQ ID NO: 154 - protein, 18 aa, Artificial Sequence
  source: /note="Description of Artificial Sequence: Synthetic peptide"
GSTSGSGKPGSGEGSTKG

SEQ ID NO: 155 - protein, 19 aa, Artificial Sequence
  source: /note="Description of Artificial Sequence: Synthetic peptide"
PRGASKSGSASQTGSAPGS

SEQ ID NO: 156 - protein, 19 aa, Artificial Sequence
  source: /note="Description of Artificial Sequence: Synthetic peptide"
GTAAAGAGAAGGAAAGAAG

SEQ ID NO: 157 - protein, 19 aa, Artificial Sequence
  source: /note="Description of Artificial Sequence: Synthetic peptide"
GTSGSSGSGSGGSGSGGGG

SEQ ID NO: 158 - protein, 20 aa, Artificial Sequence
  source: /note="Description of Artificial Sequence: Synthetic peptide"
GKPGSGKPGSGKPGSGKPGS

SEQ ID NO: 159 - protein, 445 aa, Artificial Sequence; identical to SEQ ID NO: 85
  source: /note="Description of Artificial Sequence: Synthetic polypeptide"

SEQ ID NO: 160 - protein, 714 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 161 - protein, 214 aa, Artificial Sequence; identical to SEQ ID NO: 87
  source: /note="Description of Artificial Sequence: Synthetic polypeptide"

SEQ ID NO: 162 - protein, 585 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSS

SEQ ID NO: 163 - protein, 569 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 164 - protein, 214 aa, Artificial Sequence; identical to SEQ ID NO: 87
  source: /note="Description of Artificial Sequence: Synthetic polypeptide"

SEQ ID NO: 165 - protein, 445 aa, Artificial Sequence; identical to SEQ ID NO: 85
  source: /note="Description of Artificial Sequence: Synthetic polypeptide"

SEQ ID NO: 166 - protein, 718 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 214 aa, Artificial Sequence; identical to SEQ ID NO: 87
  source: /note="Description of Artificial Sequence: Synthetic polypeptide"

SEQ ID NO: 168 - protein, 231 aa, Artificial Sequence
  source: /note="Description of Artificial Sequence: Synthetic polypeptide"
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 169 - protein, 718 aa, Artificial Sequence; identical to SEQ ID NO: 166
  source: /note="Description of Artificial Sequence: Synthetic polypeptide"

SEQ ID NO: 170 - protein, 214 aa, Artificial Sequence; identical to SEQ ID NO: 87
  source: /note="Description of Artificial Sequence: Synthetic polypeptide"

SEQ ID NO: 171 - protein, 589 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGGGGSGGGGSKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 172 - protein, 573 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 214 aa, Artificial Sequence; identical to SEQ ID NO: 87
  source: /note="Description of Artificial Sequence: Synthetic polypeptide"

SEQ ID NO: 174 - protein, 231 aa, Artificial Sequence; identical to SEQ ID NO: 168
  source: /note="Description of Artificial Sequence: Synthetic polypeptide"

SEQ ID NO: 175 - protein, 714 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 176 - protein, 214 aa, Artificial Sequence; identical to SEQ ID NO: 87
  source: /note="Description of Artificial Sequence: Synthetic polypeptide"

SEQ ID NO: 177 - protein, 231 aa, Artificial Sequence; identical to SEQ ID NO: 168
  source: /note="Description of Artificial Sequence: Synthetic polypeptide"

SEQ ID NO: 178 - protein, 714 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSEVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 179 - protein, 214 aa, Artificial Sequence; identical to SEQ ID NO: 87
  source: /note="Description of Artificial Sequence: Synthetic polypeptide"

SEQ ID NO: 180 - protein, 231 aa, Artificial Sequence; identical to SEQ ID NO: 168
  source: /note="Description of Artificial Sequence: Synthetic polypeptide"

SEQ ID NO: 181 - protein, 714 aa, Artificial Sequence; identical to SEQ ID NO: 160
  source: /note="Description of Artificial Sequence: Synthetic polypeptide"

SEQ ID NO: 182 - protein, 214 aa, Artificial Sequence; identical to SEQ ID NO: 87
  source: /note="Description of Artificial Sequence: Synthetic polypeptide"

SEQ ID NO: 183 - protein, 231 aa, Artificial Sequence; identical to SEQ ID NO: 168
  source: /note="Description of Artificial Sequence: Synthetic polypeptide"

SEQ ID NO: 184 - protein, 718 aa, Artificial Sequence
  source: /note="Description of Artificial Sequence: Synthetic polypeptide"
EVQLVESGGGLVQPGGSLRLSCAASGFDFSRSWMNWVRQAPGKGLEWVSEINPDSSTINYATSVKGRFTISRDNSKNTLYLQMNSLRAEDTAVYYCARYGNWFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSEVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 214 aa, Artificial Sequence; identical to SEQ ID NO: 87
  source: /note="Description of Artificial Sequence: Synthetic polypeptide"

SEQ ID NO: 186 - protein, 231 aa, Artificial Sequence; identical to SEQ ID NO: 168
  source: /note="Description of Artificial Sequence: Synthetic polypeptide"

SEQ ID NO: 187 - protein, 718 aa, Artificial Sequence; identical to SEQ ID NO: 184
  source: /note="Description of Artificial Sequence: Synthetic polypeptide"

SEQ ID NO: 188 - protein, 214 aa, Artificial Sequence; identical to SEQ ID NO: 87
  source: /note="Description of Artificial Sequence: Synthetic polypeptide"

SEQ ID NO: 189 - protein, 231 aa, Artificial Sequence; identical to SEQ ID NO: 168
  source: /note="Description of Artificial Sequence: Synthetic polypeptide"

SEQ ID NO: 190 - protein, 718 aa, Artificial Sequence; identical to SEQ ID NO: 166
  source: /note="Description of Artificial Sequence: Synthetic polypeptide"

SEQ ID NO: 191 - protein, 214 aa, Artificial Sequence; identical to SEQ ID NO: 87
  source: /note="Description of Artificial Sequence: Synthetic polypeptide"

SEQ ID NO: 192 - protein, 445 aa, Artificial Sequence; identical to SEQ ID NO: 85
  source: /note="Description of Artificial Sequence: Synthetic polypeptide"

SEQ ID NO: 193 - protein, 714 aa, Artificial Sequence; identical to SEQ ID NO: 175
  source: /note="Description of Artificial Sequence: Synthetic polypeptide"

SEQ ID NO: 194 - protein, 214 aa, Artificial Sequence; identical to SEQ ID NO: 87
  source: /note="Description of Artificial Sequence: Synthetic polypeptide"

SEQ ID NO: 195 - protein, 445 aa, Artificial Sequence; identical to SEQ ID NO: 85
  source: /note="Description of Artificial Sequence: Synthetic polypeptide"

SEQ ID NO: 196 - protein, 714 aa, Artificial Sequence; identical to SEQ ID NO: 178
  source: /note="Description of Artificial Sequence: Synthetic polypeptide"

SEQ ID NO: 197 - protein, 214 aa, Artificial Sequence; identical to SEQ ID NO: 87
  source: /note="Description of Artificial Sequence: Synthetic polypeptide"

SEQ ID NO: 198 - protein, 445 aa, Artificial Sequence; identical to SEQ ID NO: 85
  source: /note="Description of Artificial Sequence: Synthetic polypeptide"

SEQ ID NO: 199 - protein, 714 aa, Artificial Sequence; identical to SEQ ID NO: 160
  source: /note="Description of Artificial Sequence: Synthetic polypeptide"

SEQ ID NO: 200 - protein, 214 aa, Artificial Sequence; identical to SEQ ID NO: 87
  source: /note="Description of Artificial Sequence: Synthetic polypeptide"

SEQ ID NO: 201 - protein, 445 aa, Artificial Sequence; identical to SEQ ID NO: 85
  source: /note="Description of Artificial Sequence: Synthetic polypeptide"

SEQ ID NO: 202 - protein, 718 aa, Artificial Sequence; identical to SEQ ID NO: 184
  source: /note="Description of Artificial Sequence: Synthetic polypeptide"

SEQ ID NO: 203 - protein, 214 aa, Artificial Sequence; identical to SEQ ID NO: 87
  source: /note="Description of Artificial Sequence: Synthetic polypeptide"

SEQ ID NO: 204 - protein, 445 aa, Artificial Sequence; identical to SEQ ID NO: 85
  source: /note="Description of Artificial Sequence: Synthetic polypeptide"

SEQ ID NO: 205 - protein, 718 aa, Artificial Sequence; identical to SEQ ID NO: 184
  source: /note="Description of Artificial Sequence: Synthetic polypeptide"

SEQ ID NO: 206 - protein, 214 aa, Artificial Sequence; identical to SEQ ID NO: 87
  source: /note="Description of Artificial Sequence: Synthetic polypeptide"

SEQ ID NO: 207 - protein, 445 aa, Artificial Sequence; identical to SEQ ID NO: 85
  source: /note="Description of Artificial Sequence: Synthetic polypeptide"

SEQ ID NO: 208 - protein, 718 aa, Artificial Sequence; identical to SEQ ID NO: 166
  source: /note="Description of Artificial Sequence: Synthetic polypeptide"

SEQ ID NO: 209 - protein, 214 aa, Artificial Sequence; identical to SEQ ID NO: 87
  source: /note="Description of Artificial Sequence: Synthetic polypeptide"

SEQ ID NO: 210 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 211 - protein, 254 aa, Artificial Sequence; identical to SEQ ID NO: 9
  source: /note="Description of Artificial Sequence: Synthetic polypeptide"

SEQ ID NO: 212 - protein, 125 aa, Artificial Sequence; identical to SEQ ID NO: 1
  source: /note="Description of Artificial Sequence: Synthetic polypeptide"

SEQ ID NO: 213 - protein, 109 aa, Artificial Sequence; identical to SEQ ID NO: 5
  source: /note="Description of Artificial Sequence: Synthetic polypeptide"

SEQ ID NO: 214 - protein, 262 aa, Artificial Sequence; identical to SEQ ID NO: 210
  source: /note="Description of Artificial Sequence: Synthetic polypeptide"

SEQ ID NO: 215 - protein, 254 aa, Artificial Sequence; identical to SEQ ID NO: 9
  source: /note="Description of Artificial Sequence: Synthetic polypeptide"

SEQ ID NO: 216 - protein, 125 aa, Artificial Sequence; identical to SEQ ID NO: 1
  source: /note="Description of Artificial Sequence: Synthetic polypeptide"

SEQ ID NO: 217 - protein, 109 aa, Artificial Sequence; identical to SEQ ID NO: 5
  source: /note="Description of Artificial Sequence: Synthetic polypeptide"

SEQ ID NO: 218 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 219 - protein, 254 aa, Artificial Sequence; identical to SEQ ID NO: 45
  source: /note="Description of Artificial Sequence: Synthetic polypeptide"

SEQ ID NO: 220 - protein, 125 aa, Artificial Sequence; identical to SEQ ID NO: 37
  source: /note="Description of Artificial Sequence: Synthetic polypeptide"

SEQ ID NO: 221 - protein, 109 aa, Artificial Sequence; identical to SEQ ID NO: 5
  source: /note="Description of Artificial Sequence: Synthetic polypeptide"

SEQ ID NO: 222 - protein, 262 aa, Artificial Sequence
  source: /note="Description of Artificial Sequence: Synthetic polypeptide"
EVQLVESGGGLVQPGGSLRLSCAASGFTFSTYAMSWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 223 - protein, 254 aa, Artificial Sequence; identical to SEQ ID NO: 54
  source: /note="Description of Artificial Sequence: Synthetic polypeptide"

SEQ ID NO: 224 - protein, 125 aa, Artificial Sequence; identical to SEQ ID NO: 46
  source: /note="Description of Artificial Sequence: Synthetic polypeptide"

SEQ ID NO: 225 - protein, 109 aa, Artificial Sequence; identical to SEQ ID NO: 5
  source: /note="Description of Artificial Sequence: Synthetic polypeptide"

SEQ ID NO: 226 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 227 - protein, 254 aa, Artificial Sequence; identical to SEQ ID NO: 18
  source: /note="Description of Artificial Sequence: Synthetic polypeptide"

SEQ ID NO: 228 - protein, 125 aa, Artificial Sequence; identical to SEQ ID NO: 10
  source: /note="Description of Artificial Sequence: Synthetic polypeptide"

SEQ ID NO: 229 - protein, 109 aa, Artificial Sequence; identical to SEQ ID NO: 5
  source: /note="Description of Artificial Sequence: Synthetic polypeptide"

SEQ ID NO: 230 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 231 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 232 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSS

SEQ ID NO: 233 - protein, 109 aa, Artificial Sequence; identical to SEQ ID NO: 5
  source: /note="Description of Artificial Sequence: Synthetic polypeptide"

SEQ ID NO: 234 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 235 - protein, 254 aa, Artificial Sequence; identical to SEQ ID NO: 27
  source: /note="Description of Artificial Sequence: Synthetic polypeptide"

SEQ ID NO: 236 - protein, 125 aa, Artificial Sequence; identical to SEQ ID NO: 19
  source: /note="Description of Artificial Sequence: Synthetic polypeptide"

SEQ ID NO: 237 - protein, 109 aa, Artificial Sequence; identical to SEQ ID NO: 5
  source: /note="Description of Artificial Sequence: Synthetic polypeptide"

SEQ ID NO: 238 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 239 - protein, 254 aa, Artificial Sequence; identical to SEQ ID NO: 36
  source: /note="Description of Artificial Sequence: Synthetic polypeptide"

SEQ ID NO: 240 - protein, 125 aa, Artificial Sequence; identical to SEQ ID NO: 28
  source: /note="Description of Artificial Sequence: Synthetic polypeptide"

SEQ ID NO: 241 - protein, 109 aa, Artificial Sequence; identical to SEQ ID NO: 5
  source: /note="Description of Artificial Sequence: Synthetic polypeptide"

SEQ ID NO: 242 - protein, 262 aa, Artificial Sequence; identical to SEQ ID NO: 226
  source: /note="Description of Artificial Sequence: Synthetic polypeptide"

SEQ ID NO: 243 - protein, 254 aa, Artificial Sequence; identical to SEQ ID NO: 18
  source: /note="Description of Artificial Sequence: Synthetic polypeptide"

SEQ ID NO: 244 - protein, 125 aa, Artificial Sequence; identical to SEQ ID NO: 10
  source: /note="Description of Artificial Sequence: Synthetic polypeptide"

SEQ ID NO: 245 - protein, 109 aa, Artificial Sequence; identical to SEQ ID NO: 5
  source: /note="Description of Artificial Sequence: Synthetic polypeptide"

SEQ ID NO: 246 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 247 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 248 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSS

SEQ ID NO: 249 - protein, 109 aa, Artificial Sequence; identical to SEQ ID NO: 5
  source: /note="Description of Artificial Sequence: Synthetic polypeptide"

SEQ ID NO: 250 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 251 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 252 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSS

SEQ ID NO: 253 - protein, 109 aa, Artificial Sequence; identical to SEQ ID NO: 5
  source: /note="Description of Artificial Sequence: Synthetic polypeptide"

SEQ ID NO: 254 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 255 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 256 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSS

SEQ ID NO: 257 - protein, 109 aa, Artificial Sequence; identical to SEQ ID NO: 5
  source: /note="Description of Artificial Sequence: Synthetic polypeptide"

SEQ ID NO: 258 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 259 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 260 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFAYWGQGTLVTVSS

SEQ ID NO: 261 - protein, 109 aa, Artificial Sequence; identical to SEQ ID NO: 5
  source: /note="Description of Artificial Sequence: Synthetic polypeptide"

SEQ ID NO: 262 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 263 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 264 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSS

SEQ ID NO: 265 - protein, 109 aa, Artificial Sequence; identical to SEQ ID NO: 5
  source: /note="Description of Artificial Sequence: Synthetic polypeptide"

SEQ ID NO: 266 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 267 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 268 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSS

SEQ ID NO: 269 - protein, 109 aa, Artificial Sequence; identical to SEQ ID NO: 5
  source: /note="Description of Artificial Sequence: Synthetic polypeptide"

SEQ ID NO: 270 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 271 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 272 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSS

SEQ ID NO: 273 - protein, 109 aa, Artificial Sequence; identical to SEQ ID NO: 5
  source: /note="Description of Artificial Sequence: Synthetic polypeptide"

SEQ ID NO: 274 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 275 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 276 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSS

SEQ ID NO: 277 - protein, 109 aa, Artificial Sequence; identical to SEQ ID NO: 5
  source: /note="Description of Artificial Sequence: Synthetic polypeptide"

SEQ ID NO: 278 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 279 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 280 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSS

SEQ ID NO: 281 - protein, 109 aa, Artificial Sequence; identical to SEQ ID NO: 5
  source: /note="Description of Artificial Sequence: Synthetic polypeptide"

SEQ ID NO: 282 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 283 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 284 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSS

SEQ ID NO: 285 - protein, 109 aa, Artificial Sequence; identical to SEQ ID NO: 5
  source: /note="Description of Artificial Sequence: Synthetic polypeptide"

SEQ ID NO: 286 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 287 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 288 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSS

SEQ ID NO: 289 - protein, 109 aa, Artificial Sequence; identical to SEQ ID NO: 5
  source: /note="Description of Artificial Sequence: Synthetic polypeptide"

SEQ ID NO: 290 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 291 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 292 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSS

SEQ ID NO: 293 - protein, 109 aa, Artificial Sequence; identical to SEQ ID NO: 5
  source: /note="Description of Artificial Sequence: Synthetic polypeptide"

SEQ ID NO: 294 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 295 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 296 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSS

SEQ ID NO: 297 - protein, 109 aa, Artificial Sequence; identical to SEQ ID NO: 5
  source: /note="Description of Artificial Sequence: Synthetic polypeptide"

SEQ ID NO: 298 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 299 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 300 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSS

SEQ ID NO: 301 - protein, 109 aa, Artificial Sequence; identical to SEQ ID NO: 5
  source: /note="Description of Artificial Sequence: Synthetic polypeptide"

SEQ ID NO: 302 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 303 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 304 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSS

SEQ ID NO: 305 - protein, 109 aa, Artificial Sequence; identical to SEQ ID NO: 5
  source: /note="Description of Artificial Sequence: Synthetic polypeptide"

SEQ ID NO: 306 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 307 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 308 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSS

SEQ ID NO: 309 - protein, 109 aa, Artificial Sequence; identical to SEQ ID NO: 5
  source: /note="Description of Artificial Sequence: Synthetic polypeptide"

SEQ ID NO: 310 - protein, 262 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLGSHHHHHH

SEQ ID NO: 311 - protein, 254 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVL

SEQ ID NO: 312 - protein, 125 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSS

SEQ ID NO: 313 - protein, 109 aa, Artificial Sequence; identical to SEQ ID NO: 5
  source: /note="Description of Artificial Sequence: Synthetic polypeptide"

SEQ ID NO: 314 - protein, 450 aa, Artificial Sequence
  source: /note="Description of Artificial Sequence: Synthetic polypeptide"
EVQLVESGGGLVKPGGSLKLSCAASGYTFTSYVMHWVRQAPGGGLEWIGYINPYNDGTKYNEKFKGRVTISSDKSKSTAYMELSSLRSEDTAVYYCARGTYYYGTRVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 315 - protein, 485 aa, Artificial Sequence; identical to SEQ ID NO: 83
  source: /note="Description of Artificial Sequence: Synthetic polypeptide"

SEQ ID NO: 316 - protein, 219 aa, Artificial Sequence
  source: /note="Description of Artificial Sequence: Synthetic polypeptide"
DIVMTQSPATLSLSPGERATISCRSSKSLQNVNGNTYLYWFQQKPGQSPKLLIYRASNLNSGVPDRFSGSGSGTEFTLTISSLEPEDFAVYYCMQHLEYPITFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 450 aa, Artificial Sequence; identical to SEQ ID NO: 314
  source: /note="Description of Artificial Sequence: Synthetic polypeptide"

SEQ ID NO: 318 - protein, 485 aa, Artificial Sequence; identical to SEQ ID NO: 89
  source: /note="Description of Artificial Sequence: Synthetic polypeptide"

SEQ ID NO: 319 - protein, 219 aa, Artificial Sequence; identical to SEQ ID NO: 316
  source: /note="Description of Artificial Sequence: Synthetic polypeptide"

SEQ ID NO: 320 - protein, 450 aa, Artificial Sequence; identical to SEQ ID NO: 314
  source: /note="Description of Artificial Sequence: Synthetic polypeptide"

SEQ ID NO: 321 - protein, 485 aa, Artificial Sequence; identical to SEQ ID NO: 92
  source: /note="Description of Artificial Sequence: Synthetic polypeptide"

SEQ ID NO: 322 - protein, 219 aa, Artificial Sequence; identical to SEQ ID NO: 316
  source: /note="Description of Artificial Sequence: Synthetic polypeptide"

SEQ ID NO: 323 - protein, 450 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNQKFQGRVTITADKSISTAYMELSSLRSEDTAVYYCARSTYYGGDWYFNVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 324 - protein, 485 aa, Artificial Sequence; identical to SEQ ID NO: 83
  source: /note="Description of Artificial Sequence: Synthetic polypeptide"

SEQ ID NO: 325 - protein, 213 aa, Artificial Sequence
  source: /note="Description of Artificial Sequence: Synthetic polypeptide"
QIVLTQSPSSLSASVGDRVTITCRASSSVSYIHWFQQKPGKSPKPLIYATSNLASGVPVRFSGSGSGTDYTLTISSLQPEDFATYYCQQWTSNPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 326 - protein, 450 aa, Artificial Sequence; identical to SEQ ID NO: 323
  source: /note="Description of Artificial Sequence: Synthetic polypeptide"

SEQ ID NO: 327 - protein, 485 aa, Artificial Sequence; identical to SEQ ID NO: 89
  source: /note="Description of Artificial Sequence: Synthetic polypeptide"

SEQ ID NO: 328 - protein, 213 aa, Artificial Sequence; identical to SEQ ID NO: 325
  source: /note="Description of Artificial Sequence: Synthetic polypeptide"

SEQ ID NO: 329 - protein, 450 aa, Artificial Sequence; identical to SEQ ID NO: 323
  source: /note="Description of Artificial Sequence: Synthetic polypeptide"

SEQ ID NO: 330 - protein, 485 aa, Artificial Sequence; identical to SEQ ID NO: 104
  source: /note="Description of Artificial Sequence: Synthetic polypeptide"

SEQ ID NO: 331 - protein, 213 aa, Artificial Sequence; identical to SEQ ID NO: 325
  source: /note="Description of Artificial Sequence: Synthetic polypeptide"

SEQ ID NO: 332 - protein, 450 aa, Artificial Sequence; identical to SEQ ID NO: 323
  source: /note="Description of Artificial Sequence: Synthetic polypeptide"

SEQ ID NO: 333 - protein, 485 aa, Artificial Sequence; identical to SEQ ID NO: 92
  source: /note="Description of Artificial Sequence: Synthetic polypeptide"

SEQ ID NO: 334 - protein, 213 aa, Artificial Sequence; identical to SEQ ID NO: 325
  source: /note="Description of Artificial Sequence: Synthetic polypeptide"

SEQ ID NO: 335 - protein, 450 aa, Artificial Sequence; identical to SEQ ID NO: 323
  source: /note="Description of Artificial Sequence: Synthetic polypeptide"

SEQ ID NO: 336 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGPSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 213 aa, Artificial Sequence; identical to SEQ ID NO: 325
  source: /note="Description of Artificial Sequence: Synthetic polypeptide"

SEQ ID NO: 338 - protein, 450 aa, Artificial Sequence; identical to SEQ ID NO: 323
  source: /note="Description of Artificial Sequence: Synthetic polypeptide"

SEQ ID NO: 339 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 340 - protein, 213 aa, Artificial Sequence; identical to SEQ ID NO: 325
  source: /note="Description of Artificial Sequence: Synthetic polypeptide"

SEQ ID NO: 341 - protein, 450 aa, Artificial Sequence; identical to SEQ ID NO: 323
  source: /note="Description of Artificial Sequence: Synthetic polypeptide"

SEQ ID NO: 342 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 343 - protein, 213 aa, Artificial Sequence; identical to SEQ ID NO: 325
  source: /note="Description of Artificial Sequence: Synthetic polypeptide"

SEQ ID NO: 344 - protein, 450 aa, Artificial Sequence; identical to SEQ ID NO: 323
  source: /note="Description of Artificial Sequence: Synthetic polypeptide"

SEQ ID NO: 345 - protein, 485 aa, Artificial Sequence; identical to SEQ ID NO: 104
  source: /note="Description of Artificial Sequence: Synthetic polypeptide"

SEQ ID NO: 346 - protein, 213 aa, Artificial Sequence; identical to SEQ ID NO: 325
  source: /note="Description of Artificial Sequence: Synthetic polypeptide"

SEQ ID NO: 347 - protein, 450 aa, Artificial Sequence; identical to SEQ ID NO: 323
  source: /note="Description of Artificial Sequence: Synthetic polypeptide"

SEQ ID NO: 348 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 213 aa, Artificial Sequence; identical to SEQ ID NO: 325
  source: /note="Description of Artificial Sequence: Synthetic polypeptide"

SEQ ID NO: 350 - protein, 450 aa, Artificial Sequence; identical to SEQ ID NO: 323
  source: /note="Description of Artificial Sequence: Synthetic polypeptide"

SEQ ID NO: 351 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGESYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 213 aa, Artificial Sequence; identical to SEQ ID NO: 325
  source: /note="Description of Artificial Sequence: Synthetic polypeptide"

SEQ ID NO: 353 - protein, 450 aa, Artificial Sequence; identical to SEQ ID NO: 323
  source: /note="Description of Artificial Sequence: Synthetic polypeptide"

SEQ ID NO: 354 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 213 aa, Artificial Sequence; identical to SEQ ID NO: 325
  source: /note="Description of Artificial Sequence: Synthetic polypeptide"

SEQ ID NO: 356 - protein, 450 aa, Artificial Sequence; identical to SEQ ID NO: 323
  source: /note="Description of Artificial Sequence: Synthetic polypeptide"

SEQ ID NO: 357 - protein, 485 aa, Artificial Sequence; identical to SEQ ID NO: 339
  source: /note="Description of Artificial Sequence: Synthetic polypeptide"

SEQ ID NO: 358 - protein, 213 aa, Artificial Sequence; identical to SEQ ID NO: 325
  source: /note="Description of Artificial Sequence: Synthetic polypeptide"

SEQ ID NO: 359 - protein, 450 aa, Artificial Sequence; identical to SEQ ID NO: 323
  source: /note="Description of Artificial Sequence: Synthetic polypeptide"

SEQ ID NO: 360 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 213 aa, Artificial Sequence; identical to SEQ ID NO: 325
  source: /note="Description of Artificial Sequence: Synthetic polypeptide"

SEQ ID NO: 362 - protein, 450 aa, Artificial Sequence
  source: /note="Description of Artificial Sequence: Synthetic polypeptide"
QVQLVQSGAEVKKPGASVKVSCKASGYTFTSYNMHWVRQAPGQRLEWMGAIYPGNGATSYSQKFQGRVTITADTSASTAYMELSSLRSEDTAVYYCARSYYMGGDWYFDVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 363 - protein, 485 aa, Artificial Sequence; identical to SEQ ID NO: 83
  source: /note="Description of Artificial Sequence: Synthetic polypeptide"

SEQ ID NO: 364 - protein, 213 aa, Artificial Sequence
  source: /note="Description of Artificial Sequence: Synthetic polypeptide"
QIVLTQSPSSLSASVGDRVTITCRASWSVSYIHWFQQKPGKSPKPLIYATSNLASGVPVRFSGSGSGTDYTLTISSLQPEDFATYYCQQWTHNPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 365 - protein, 450 aa, Artificial Sequence; identical to SEQ ID NO: 362
  source: /note="Description of Artificial Sequence: Synthetic polypeptide"

SEQ ID NO: 366 - protein, 485 aa, Artificial Sequence; identical to SEQ ID NO: 89
  source: /note="Description of Artificial Sequence: Synthetic polypeptide"

SEQ ID NO: 367 - protein, 213 aa, Artificial Sequence; identical to SEQ ID NO: 364
  source: /note="Description of Artificial Sequence: Synthetic polypeptide"

SEQ ID NO: 368 - protein, 450 aa, Artificial Sequence; identical to SEQ ID NO: 362
  source: /note="Description of Artificial Sequence: Synthetic polypeptide"

SEQ ID NO: 369 - protein, 485 aa, Artificial Sequence; identical to SEQ ID NO: 104
  source: /note="Description of Artificial Sequence: Synthetic polypeptide"

SEQ ID NO: 370 - protein, 213 aa, Artificial Sequence; identical to SEQ ID NO: 364
  source: /note="Description of Artificial Sequence: Synthetic polypeptide"

SEQ ID NO: 371 - protein, 450 aa, Artificial Sequence; identical to SEQ ID NO: 362
  source: /note="Description of Artificial Sequence: Synthetic polypeptide"

SEQ ID NO: 372 - protein, 485 aa, Artificial Sequence; identical to SEQ ID NO: 92
  source: /note="Description of Artificial Sequence: Synthetic polypeptide"

SEQ ID NO: 373 - protein, 213 aa, Artificial Sequence; identical to SEQ ID NO: 364
  source: /note="Description of Artificial Sequence: Synthetic polypeptide"

SEQ ID NO: 374 - protein, 450 aa, Artificial Sequence; identical to SEQ ID NO: 362
  source: /note="Description of Artificial Sequence: Synthetic polypeptide"

SEQ ID NO: 375 - protein, 485 aa, Artificial Sequence; identical to SEQ ID NO: 336
  source: /note="Description of Artificial Sequence: Synthetic polypeptide"

SEQ ID NO: 376 - protein, 213 aa, Artificial Sequence; identical to SEQ ID NO: 364
  source: /note="Description of Artificial Sequence: Synthetic polypeptide"

SEQ ID NO: 377 - protein, 450 aa, Artificial Sequence; identical to SEQ ID NO: 362
  source: /note="Description of Artificial Sequence: Synthetic polypeptide"

SEQ ID NO: 378 - protein, 485 aa, Artificial Sequence; identical to SEQ ID NO: 339
  source: /note="Description of Artificial Sequence: Synthetic polypeptide"

SEQ ID NO: 379 - protein, 213 aa, Artificial Sequence; identical to SEQ ID NO: 364
  source: /note="Description of Artificial Sequence: Synthetic polypeptide"

SEQ ID NO: 380 - protein, 450 aa, Artificial Sequence; identical to SEQ ID NO: 362
  source: /note="Description of Artificial Sequence: Synthetic polypeptide"

SEQ ID NO: 381 - protein, 485 aa, Artificial Sequence; identical to SEQ ID NO: 342
  source: /note="Description of Artificial Sequence: Synthetic polypeptide"

SEQ ID NO: 382 - protein, 213 aa, Artificial Sequence; identical to SEQ ID NO: 364
  source: /note="Description of Artificial Sequence: Synthetic polypeptide"

SEQ ID NO: 383 - protein, 450 aa, Artificial Sequence; identical to SEQ ID NO: 362
  source: /note="Description of Artificial Sequence: Synthetic polypeptide"

SEQ ID NO: 384 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATYYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 213 aa, Artificial Sequence; identical to SEQ ID NO: 364
  source: /note="Description of Artificial Sequence: Synthetic polypeptide"

SEQ ID NO: 386 - protein, 450 aa, Artificial Sequence; identical to SEQ ID NO: 362
  source: /note="Description of Artificial Sequence: Synthetic polypeptide"

SEQ ID NO: 387 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 213 aa, Artificial Sequence; identical to SEQ ID NO: 364
  source: /note="Description of Artificial Sequence: Synthetic polypeptide"

SEQ ID NO: 389 - protein, 450 aa, Artificial Sequence; identical to SEQ ID NO: 362
  source: /note="Description of Artificial Sequence: Synthetic polypeptide"

SEQ ID NO: 390 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGASYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 213 aa, Artificial Sequence; identical to SEQ ID NO: 364
  source: /note="Description of Artificial Sequence: Synthetic polypeptide"

SEQ ID NO: 392 - protein, 450 aa, Artificial Sequence; identical to SEQ ID NO: 362
  source: /note="Description of Artificial Sequence: Synthetic polypeptide"

SEQ ID NO: 393 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGQSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 213 aa, Artificial Sequence; identical to SEQ ID NO: 364
  source: /note="Description of Artificial Sequence: Synthetic polypeptide"

SEQ ID NO: 395 - protein, 450 aa, Artificial Sequence; identical to SEQ ID NO: 362
  source: /note="Description of Artificial Sequence: Synthetic polypeptide"

SEQ ID NO: 396 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDEYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 213 aa, Artificial Sequence; identical to SEQ ID NO: 364
  source: /note="Description of Artificial Sequence: Synthetic polypeptide"

SEQ ID NO: 398 - protein, 450 aa, Artificial Sequence; identical to SEQ ID NO: 362
  source: /note="Description of Artificial Sequence: Synthetic polypeptide"

SEQ ID NO: 399 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDNYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 213 aa, Artificial Sequence; identical to SEQ ID NO: 364
  source: /note="Description of Artificial Sequence: Synthetic polypeptide"

SEQ ID NO: 401 - protein, 450 aa, Artificial Sequence; identical to SEQ ID NO: 362
  source: /note="Description of Artificial Sequence: Synthetic polypeptide"

SEQ ID NO: 402 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDPYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 213 aa, Artificial Sequence; identical to SEQ ID NO: 364
  source: /note="Description of Artificial Sequence: Synthetic polypeptide"

SEQ ID NO: 404 - protein, 450 aa, Artificial Sequence; identical to SEQ ID NO: 362
  source: /note="Description of Artificial Sequence: Synthetic polypeptide"

SEQ ID NO: 405 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDQYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - protein, 213 aa, Artificial Sequence; identical to SEQ ID NO: 364
  source: /note="Description of Artificial Sequence: Synthetic polypeptide"

SEQ ID NO: 407 - protein, 450 aa, Artificial Sequence; identical to SEQ ID NO: 362
  source: /note="Description of Artificial Sequence: Synthetic polypeptide"

SEQ ID NO: 408 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 213 aa, Artificial Sequence; identical to SEQ ID NO: 364
  source: /note="Description of Artificial Sequence: Synthetic polypeptide"

SEQ ID NO: 410 - protein, 450 aa, Artificial Sequence; identical to SEQ ID NO: 362
  source: /note="Description of Artificial Sequence: Synthetic polypeptide"

SEQ ID NO: 411 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGASYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 412 - protein, 213 aa, Artificial Sequence; identical to SEQ ID NO: 364
  source: /note="Description of Artificial Sequence: Synthetic polypeptide"

SEQ ID NO: 413 - protein, 450 aa, Artificial Sequence; identical to SEQ ID NO: 362
  source: /note="Description of Artificial Sequence: Synthetic polypeptide"

SEQ ID NO: 414 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGQSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 415 - protein, 213 aa, Artificial Sequence; identical to SEQ ID NO: 364
  source: /note="Description of Artificial Sequence: Synthetic polypeptide"

SEQ ID NO: 416 - protein, 450 aa, Artificial Sequence; identical to SEQ ID NO: 362
  source: /note="Description of Artificial Sequence: Synthetic polypeptide"

SEQ ID NO: 417 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKANNYATAYADSVKGRFTISRDDSKNTLYLQMNSLRAEDTAVYYCVRHGNFGDSYVSWFDYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 418 - protein, 213 aa, Artificial Sequence; identical to SEQ ID NO: 364
  source: /note="Description of Artificial Sequence: Synthetic polypeptide"

SEQ ID NO: 419 - protein, 297 aa, Homo sapiens
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 420 - protein, 378 aa, Homo sapiens
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 421 - protein, 116 aa, Artificial Sequence
  source: /note="Description of Artificial Sequence: Synthetic polypeptide"
QVQLVQSGAEVKKPGASVKVSCKASGYTFTWVRQAPGQRLEWMGAIYPGNGATSYSQKFQGRVTITADTSASTAYMELSSLRSEDTAVYYCARSYYMGGDWYFDVWGAGTLVTVSS

SEQ ID NO: 422 - protein, 5 aa, Artificial Sequence
  source: /note="Description of Artificial Sequence: Synthetic peptide"
SYNMH

SEQ ID NO: 423 - protein, 17 aa, Artificial Sequence
  source: /note="Description of Artificial Sequence: Synthetic peptide"
AIYPGNGATSYSQKFQG

SEQ ID NO: 424 - protein, 12 aa, Artificial Sequence
  source: /note="Description of Artificial Sequence: Synthetic peptide"
SYYMGGDWYFDV

SEQ ID NO: 425 - protein, 106 aa, Artificial Sequence
  source: /note="Description of Artificial Sequence: Synthetic polypeptide"
QIVLTQSPSSLSASVGDRVTITCRASWSVSYIHWFQQKPGKSPKPLIYATSNLASGVPVRFSGSGSGTDYTLTISSLQPEDFATYYCQQWTHNPPTFGGGTKVEIK

SEQ ID NO: 426 - protein, 10 aa, Artificial Sequence
  source: /note="Description of Artificial Sequence: Synthetic peptide"
RASWSVSYIH

SEQ ID NO: 427 - protein, 7 aa, Artificial Sequence
  source: /note="Description of Artificial Sequence: Synthetic peptide"
ATSNLAS

SEQ ID NO: 428 - protein, 9 aa, Artificial Sequence
  source: /note="Description of Artificial Sequence: Synthetic peptide"
QQWTHNPPT

SEQ ID NO: 429 - protein, 242 aa, Artificial Sequence
  source: /note="Description of Artificial Sequence: Synthetic polypeptide"
QVQLVQSGAEVKKPGASVKVSCKASGYTFTWVRQAPGQRLEWMGAIYPGNGATSYSQKFQGRVTITADTSASTAYMELSSLRSEDTAVYYCARSYYMGGDWYFDVWGAGTLVTVSSGKPGSGKPGSGKPGSGKPGSQIVLTQSPSSLSASVGDRVTITCRASWSVSYIHWFQQKPGKSPKPLIYATSNLASGVPVRFSGSGSGTDYTLTISSLQPEDFATYYCQQWTHNPPTFGGGTKVEIK

SEQ ID NO: 430 - protein, 121 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNQKFQGRVTITADKSISTAYMELSSLRSEDTAVYYCARSTYYGGDWYFNVWGAGTLVTVSS

SEQ ID NO: 431 - protein, 5 aa, Artificial Sequence
  source: /note="Description of Artificial Sequence: Synthetic peptide"
SYNMH

SEQ ID NO: 432 - protein, 17 aa, Artificial Sequence
  source: /note="Description of Artificial Sequence: Synthetic peptide"
AIYPGNGDTSYNQKFQG

SEQ ID NO: 433 - protein, 12 aa, Artificial Sequence
  source: /note="Description of Artificial Sequence: Synthetic peptide"
STYYGGDWYFNV

SEQ ID NO: 434 - protein, 106 aa, Artificial Sequence
  source: /note="Description of Artificial Sequence: Synthetic polypeptide"
QIVLTQSPSSLSASVGDRVTITCRASSSVSYIHWFQQKPGKSPKPLIYATSNLASGVPVRFSGSGSGTDYTLTISSLQPEDFATYYCQQWTSNPPTFGGGTKVEIK

SEQ ID NO: 435 - protein, 10 aa, Artificial Sequence
  source: /note="Description of Artificial Sequence: Synthetic peptide"
RASSSVSYIH

SEQ ID NO: 436 - protein, 7 aa, Artificial Sequence
  source: /note="Description of Artificial Sequence: Synthetic peptide"
ATSNLAS

SEQ ID NO: 437 - protein, 9 aa, Artificial Sequence
  source: /note="Description of Artificial Sequence: Synthetic peptide"
QQWTSNPPT

SEQ ID NO: 438 - protein, 247 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNQKFQGRVTITADKSISTAYMELSSLRSEDTAVYYCARSTYYGGDWYFNVWGAGTLVTVSSGKPGSGKPGSGKPGSGKPGSQIVLTQSPSSLSASVGDRVTITCRASSSVSYIHWFQQKPGKSPKPLIYATSNLASGVPVRFSGSGSGTDYTLTISSLQPEDFATYYCQQWTSNPPTFGGGTKVEIK

SEQ ID NO: 439 - protein, 120 aa, Artificial Sequence
  source: /note="Description of Artificial Sequence: Synthetic polypeptide"
QVQLQQSGAEVKKPGASVKVSCKASGYTFTDYYMKWVKQSHGKSLEWMGDIIPSNGATFYNQKFKGKATLTVDRSTSTAYMELSSLRSEDTAVYYCARSHLLRASWFAYWGQGTLVTVSS

SEQ ID NO: 440 - protein, 5 aa, Artificial Sequence
  source: /note="Description of Artificial Sequence: Synthetic peptide"
DYYMK

SEQ ID NO: 441 - protein, 17 aa, Artificial Sequence
  source: /note="Description of Artificial Sequence: Synthetic peptide"
DIIPSNGATFYNQKFKG

SEQ ID NO: 442 - protein, 11 aa, Artificial Sequence
  source: /note="Description of Artificial Sequence: Synthetic peptide"
SHLLRASWFAY

SEQ ID NO: 443 - protein, 113 aa, Artificial Sequence
  source: /note="Description of Artificial Sequence: Synthetic polypeptide"
DFVMTQSPDSLAVSLGERATINCKSSQSLLNTGNQKNYLTWYQQKPGQPPKLLIYWASTRESGVPDRFTGSGSGTDFTLTISSLQAEDVAVYYCQNDYSYPYTFGGGTKLEIK

SEQ ID NO: 444 - protein, 17 aa, Artificial Sequence
  source: /note="Description of Artificial Sequence: Synthetic peptide"
KSSQSLLNTGNQKNYLT

SEQ ID NO: 445 - protein, 7 aa, Artificial Sequence
  source: /note="Description of Artificial Sequence: Synthetic peptide"
WASTRES

SEQ ID NO: 446 - protein, 9 aa, Artificial Sequence
  source: /note="Description of Artificial Sequence: Synthetic peptide"
QNDYSYPYT

SEQ ID NO: 447 - protein, 253 aa, Artificial Sequence
  source: /note="Description of Artificial Sequence: Synthetic polypeptide"
QVQLQQSGAEVKKPGASVKVSCKASGYTFTDYYMKWVKQSHGKSLEWMGDIIPSNGATFYNQKFKGKATLTVDRSTSTAYMELSSLRSEDTAVYYCARSHLLRASWFAYWGQGTLVTVSSGKPGSGKPGSGKPGSGKPGSDFVMTQSPDSLAVSLGERATINCKSSQSLLNTGNQKNYLTWYQQKPGQPPKLLIYWASTRESGVPDRFTGSGSGTDFTLTISSLQAEDVAVYYCQNDYSYPYTFGGGTKLEIK

SEQ ID NO: 448 - protein, 6 aa, Artificial Sequence
  source: /note="Description of Artificial Sequence: Synthetic 6xHis tag"
HHHHHH

SEQ ID NO: 449 - protein, 5 aa, Artificial Sequence
  source: /note="Description of Artificial Sequence: Synthetic peptide"
GSGGS

SEQ ID NO: 450 - protein, 5 aa, Artificial Sequence
  source: /note="Description of Artificial Sequence: Synthetic peptide"
GGGGS

SEQ ID NO: 451 - protein, 4 aa, Artificial Sequence
  source: /note="Description of Artificial Sequence: Synthetic peptide"
GGGS

SEQ ID NO: 452 - protein, 4 aa, Artificial Sequence
  source: /note="Description of Artificial Sequence: Synthetic peptide"
DEDE

SEQ ID NO: 453 - protein, 231 aa, Artificial Sequence
  XENP13760
EVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSHHHHHH

SEQ ID NO: 454 - protein, 220 aa, Artificial Sequence
  XENP13760
DFVMTQSPSSLTVTAGEKVTMSCKSSQSLLNSGNQKNYLTWYLQKPGQPPKLLIYWASTRESGVPDRFTGSGSGTDFTLTISSVQAEDLAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 455 - protein, 231 aa, Artificial Sequence
  XENP13761
QVQLVQSGAEVKKPGASVKVSCKASGYTFTDYYMKWVRQAPGQSLEWMGDIIPSNGATFYNQKFQGRVTMTVDRSTSTAYMELSSLRSEDTAVYYCTRSHLLRASWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSHHHHHH

SEQ ID NO: 456 - protein, 220 aa, Artificial Sequence
  XENP13761
DFVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 457 - protein, 231 aa, Artificial Sequence
  XENP13961
QVQLQQSGAEVKKPGASVKVSCKASGYTFTDYYMKWVRQAPGQSLEWMGDIIPSNGATFYNQKFKGKATLTVDRSTSTAYMELSSLRSEDTAVYYCARSHLLRASWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSHHHHHH

SEQ ID NO: 458 - protein, 220 aa, Artificial Sequence; identical to SEQ ID NO: 456
  XENP13961

SEQ ID NO: 459 - protein, 231 aa, Artificial Sequence
  XENP13963
QVQLQQSGAEVKKPGASVKVSCKASGYTFTDYYMKWVKQSHGKSLEWMGDIIPSNGATFYNQKFKGKATLTVDRSTSTAYMELSSLRSEDTAVYYCARSHLLRASWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSHHHHHH

SEQ ID NO: 460 - protein, 220 aa, Artificial Sequence; identical to SEQ ID NO: 456
  XENP13963

SEQ ID NO: 461 - protein, 231 aa, Artificial Sequence; identical to SEQ ID NO: 457
  XENP13965

SEQ ID NO: 462 - protein, 220 aa, Artificial Sequence
  XENP13965
DFVMTQSPDSLAVSLGERATINCKSSQSLLNTGNQKNYLTWYQQKPGQPPKLLIYWASTRESGVPDRFTGSGSGTDFTLTISSLQAEDVAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 231 aa, Artificial Sequence; identical to SEQ ID NO: 459
  XENP13967

SEQ ID NO: 464 - protein, 220 aa, Artificial Sequence; identical to SEQ ID NO: 462
  XENP13967

SEQ ID NO: 465 - protein, 449 aa, Artificial Sequence
  XENP13928
EVQLQQSGPELVKPGASVKMSCKASGYTFTDYYMKWVKQSHGKSLEWIGDIIPSNGATFYNQKFKGKATLTVDRSSSTAYMHLNSLTSEDSAVYYCTRSHLLRASWFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 466 - protein, 485 aa, Artificial Sequence; identical to SEQ ID NO: 83
  XENP13928

SEQ ID NO: 467 - protein, 220 aa, Artificial Sequence; identical to SEQ ID NO: 454
  XENP13928

SEQ ID NO: 468 - protein, 449 aa, Artificial Sequence
  XENP14045
QVQLQQSGAEVKKPGASVKVSCKASGYTFTDYYMKWVKQSHGKSLEWMGDIIPSNGATFYNQKFKGKATLTVDRSTSTAYMELSSLRSEDTAVYYCARSHLLRASWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 469 - protein, 485 aa, Artificial Sequence; identical to SEQ ID NO: 83
  XENP14045

SEQ ID NO: 470 - protein, 220 aa, Artificial Sequence; identical to SEQ ID NO: 462
  XENP14045

What is claimed is:

1. A heterodimeric antibody comprising:
   a) a first monomer comprising SEQ ID NO:323;
   b) a second monomer comprising SEQ ID NO:324; and
   c) a light chain comprising SEQ ID NO:325.

2. A nucleic acid composition comprising:
   a) a first nucleic acid sequence encoding SEQ ID NO:323;
   b) a second nucleic acid sequence encoding SEQ ID NO:324; and
   c) a third nucleic acid sequence encoding SEQ ID NO:325.

3. An expression vector composition comprising:
   a) a first expression vector comprising a first nucleic acid sequence encoding SEQ ID NO:323;
   b) a second expression vector comprising a second nucleic acid sequence encoding SEQ ID NO:324; and
   c) a third expression vector comprising a third nucleic acid sequence encoding SEQ ID NO:325.

4. A host cell comprising the expression vector composition of claim 3.

5. A method of treating leukemia in a patient comprising administering the heterodimeric antibody according to claim 1 to said patient.

* * * * *